(12) United States Patent
Møller et al.

(10) Patent No.: US 11,767,562 B2
(45) Date of Patent: Sep. 26, 2023

(54) CIRCULATING SERUM CELL-FREE DNA BIOMARKERS AND METHODS

(71) Applicant: ST. JOHN'S UNIVERSITY, Queens, NY (US)

(72) Inventors: Simon Geir Møller, Queens, NY (US); Ketan Patil, Queens, NY (US)

(73) Assignee: ST. JOHN'S UNIVERSITY, Queens, NY (US)

( * ) Notice: Subject to any disclaimer, the term of this patent is extended or adjusted under 35 U.S.C. 154(b) by 0 days.

(21) Appl. No.: 16/977,852

(22) PCT Filed: Mar. 7, 2019

(86) PCT No.: PCT/US2019/021082
§ 371 (c)(1),
(2) Date: Sep. 3, 2020

(87) PCT Pub. No.: WO2019/173552
PCT Pub. Date: Sep. 12, 2019

(65) Prior Publication Data
US 2021/0025002 A1 Jan. 28, 2021

Related U.S. Application Data

(60) Provisional application No. 62/640,205, filed on Mar. 8, 2018.

(51) Int. Cl.
*C12Q 1/6883* (2018.01)

(52) U.S. Cl.
CPC ..... *C12Q 1/6883* (2013.01); *C12Q 2600/158* (2013.01)

(58) Field of Classification Search
None
See application file for complete search history.

(56) References Cited

U.S. PATENT DOCUMENTS

| 2013/0143214 A1* | 6/2013 | Schutz | C12Q 1/6886 435/6.12 |
| 2014/0162933 A1* | 6/2014 | Hatchwell | G01N 33/6896 514/1.1 |
| 2014/0274740 A1* | 9/2014 | Srinivasan | C12Q 1/6806 435/287.2 |

FOREIGN PATENT DOCUMENTS

| CN | 106434939 | 2/2017 |
| CN | 107419008 | 12/2017 |
| JP | 2017-525371 A | 9/2017 |
| WO | 2017/083562 A1 | 5/2017 |
| WO | 2017/176630 A1 | 10/2017 |
| WO | 2018/009723 A1 | 1/2018 |
| WO | 2018/039463 A1 | 3/2018 |

OTHER PUBLICATIONS

Lowes et al Mol Neurodegeneration (2020), 15:10, pp. 1-8 (Year: 2020).*
Klopocki et al Annual Reviews Genomics Human Genetics. 2011. 12: 53-72 (Year: 2011).*
Pyle et al Ann Neurol. Dec. 1, 2015. 78:1000-1004 (Year: 2015).*
Chen et al Frontiers in Neuroscience. Jan. 24, 2017. 11:9, pp. 1-10 (Year: 2017).*
Marques, et al., "MicroRNAs in Cerebrospinal Fluid as Potential Biomarkers for Parkinson's Disease and Multiple System Atrophy", Molecular Neurobiology, vol. 54, No. 10 (2016) 7736-45.
Patil, et al., "Combinatory microRNA serum signatures as classifiers of Parkinson's disease", Parkinsonism and Related Disorders, vol. 64 (2019) 202-10.
Wang, et al., "Tiny But Mighty: Promising Roles of MicroRNAs in the Diagnosis and Treatment of Parkinson's Disease", Neuroscience Bulletin, vol. 33, No. 5 (2017) 543-51.

* cited by examiner

*Primary Examiner* — Carla J Myers
(74) *Attorney, Agent, or Firm* — VENABLE LLP

(57) ABSTRACT

Biomarkers and methods for identifying circulating serum-based cfDNA sequences. The cfDNA sequences (PDcRAs) can be used to differentiate patient's suffering from Parkinson's disease (PD) from non-PD patients.

6 Claims, No Drawings

Specification includes a Sequence Listing.

CIRCULATING SERUM CELL-FREE DNA BIOMARKERS AND METHODS

This application is a national phase of PCT Application No. PCT/US2019/021082 filed Mar. 7, 2019, which in turn claims benefit of U.S. Patent Provisional Application No. 62/640,205 filed Mar. 8, 2018, which are hereby incorporated by reference herein in their entirety.

BACKGROUND OF THE INVENTION

1. Field of the Invention

The present invention relates to identification and utility of circulating cell-free DNA in serum as diagnostic biomarkers in Parkinson's disease to diagnose the disease and assist the clinicians to determine the treatment options for a subject.

2. Brief Description of the Background Art

Parkinson's disease (PD), the second most common neurodegenerative disease, is a movement disorder characterized by the demise of dopaminergic neurons. Due to unknown etiology and lack of clinical biomarker the current treatment is only for symptomatic relief. L-dopa treatment in addition to other drug combinations alleviates the motor symptoms but cannot reverse or halt the process of neuronal cell death. There are neither any objective tests nor any established biochemical biomarkers for the diagnosis of PD. Further, the heterogeneity, subtypes and the progression of the disease makes it even complex to develop specific therapeutic candidates. Thus it is imperative to diagnose disease at the early stage to increase the efficacy of therapeutic agents as well as to employ new therapies that can be beneficial to patients.

The cell-free DNA (cfDNA) was first detected in blood plasma by Mandel and Metais in 1948 (1). It took many years before the application of cfDNA as a tool for diagnostic purpose. Initial and arguably most successful application of cfDNA was in fetal DNA-based prenatal testing that ranged from sex-determination to detect various genetically linked developmental and other diseases (2). This also points to the fact that the cfDNA found in blood has chimeric origin of diseased as well as healthy cells. cfDNA is highly fragmented, double stranded DNA is mostly 150 bp in length and found freely circulating in the blood. Most fragments of cfDNA correspond to length of nucleosome units, the primary building block of nuclear DNA. This suggests the cell death as major source of cfDNA in blood. This property of cfDNA is key to its application as a diagnostic biomarker especially in diseases associated with cell death or apoptosis. The cfDNA amounts in patient samples could differ and its function remains largely elusive after 70 years since initial discovery. Since there are factors like sample collection, blood cell lysis that can affect the cfDNA yield in plasma samples, serum can be an alternative source for biomarker discovery.

SUMMARY OF THE INVENTION

It is an object of the present invention to identify serum cfDNA sequences relevant to patients suffering from Parkinson's disease.

It is another object of the present invention to provide methods for determining patients suffering from Parkinson's disease.

These objects and others are achieved by the present invention, which provides circulating cfDNA biomarkers that may be used singly, in pairs or in combination to determine patients suffering from Parkinson's disease.

DETAILED DESCRIPTION OF THE INVENTION

Unless defined otherwise, all technical and scientific terms used herein have the meaning commonly understood by a person skilled in the art to which this invention belongs. The following references provide one of skill with a general definition of many of the terms used in this invention: Singleton et al., *Dictionary of Microbiology and Molecular Biology* (2nd ed. 1994); *The Cambridge Dictionary of Science and Technology* (Walker ed., 1988); *The Glossary of Genetics,* 5th Ed., R. Rieger et al. (eds.), Springer Verlag (1991); and Hale & Marham, *The Harper Collins Dictionary of Biology* (1991). As used herein, those following terms have the meanings ascribed to them unless specified otherwise.

Methods

Serum Samples Handling and Classification

All patients and controls participated in the Norwegian ParkWest project, which are ongoing prospective population-based longitudinal cohort studies investigating the incidence, neurobiology and prognosis of PD. The Norwegian ParkWest study is a prospective longitudinal multicenter cohort study of patients with incident Parkinson's disease (PD) from Western and Southern Norway. Between Nov. 1, 2004 and 31 Aug. 2006 it was endeavored to recruit all new cases of Parkinson Disease within the study area. Since the start of the study 212 of 265 (80%) of these patients and their age-/sex-matched control group have been followed. Further information about this project can be found through the Norwegian ParkWest study, c/o The Norwegian Center for Movement Disorders, Stavanger University Hospital, Stavanger Norway (parkvest.no).

All possible efforts were undertaken to establish an unselected and population-representative cohort of patients with PD. Patients were included if they had provided serum at study entry and fulfilled diagnostic criteria for PD at the National Institute of Neurological Disorders and Stroke Parkinson's Disease Information Page (ninds.nih.gov/disorders/parkinsons_disease/parkinsons_disease.htm) and UK Brain Bank UK Parkinson's Disease Society Brain Bank Clinical Diagnostic Criteria (ncbi.nlm.nih.gov/projects/gap/cgi-bin/GetPdfcgi?id=phd000042) at latest follow-up. Patients with secondary parkinsonism at study entry were excluded from this study. Control subjects were recruited from multiple sources, including friends, spouses, and public organizations for elderly and were included in this study if they had provided serum. All patients and controls were Caucasian.

In this study of possible biomarkers for PD we utilized serum from 6 patients and 3 controls which were selected at random.

Serum samples were collected at the same day as the clinical examinations and then stored frozen at −70 degrees Celsius until transported to the facilities in New York on dry ice.

Serum samples were collected at the same day as the clinical examinations and then stored frozen at −70 degrees Celsius until transported to the facilities in New York on dry ice.

Example 1: Analyses of Differential Levels of Human cfDNA by NGS cfDNA Isolation from Serum Samples and QC After thawing on ice, nine (three control, six PD samples) serum samples were spun down for 5 mins at 3000×g to remove debris. The supernatant was used to perform cfDNA isolation using E-Z Nucleic Acid (E.Z.N.A.®) circulating DNA Isolation Kit (Omega Bio-tek, GA). Before DNA Isolation, the samples were spiked with 0.1 pg/ul of spike-in control DNA (L34, *Zea mays*). The remaining part of the DNA isolation was performed following manufacturer's protocol. The isolated cfDNA was quantified on a Qubit 4 Fluorometer (Thermo Scientific, MA) and quality of the cfDNA was assessed by Alu assay and High sensitivity Bioanalyzer DNA assay (Agilent, CA). The cfDNA was then used for library preparation.

Library Prep, QC and Sequencing

The isolated cfDNA (15 ng) from nine patient serum samples were subjected to sequencing library preparation using Accel-NGS® 2S Plus DNA Library Kit (Swift Biosciences, MI) following manufacturer's protocol. The prepared libraries were quality checked and quantified using Qubit 4 Fluorometer (Thermo Scientific, MA), KAPA Library Quantification Kits (KAPA Biosystems, MA) and Agilent 4200 TapeStation System (Agilent, CA). The spike-in control was recovered at consistent levels for all the samples. The cfDNA libraries were sequenced using HiSeq 4000 Paired-End 100 or PE150 Cycle lanes (Illumina, CA) at NYU School of Medicine's Genome Technology Center (med.nyu.edu/research/scientific-cores-shared-resources/genome-technology-center). The fastq.gz files obtained from sequencing runs were imported into Partek Flow (Partek, MO) for analysis.

NGS Data Analysis

Paired end sequencing data was imported into Partek Flow for data analysis. Quality control analysis demonstrated a read depth range of 47,627,391-100,811,153, with a mean depth of 83,311,383. The data was also checked to ensure appropriate sequence quality with regards to average base score quality, the percent of missing bases, and GC content. Alignment of sequencing reads to the hg19 version of the human genome assembly was performed using default parameters of the MEM algorithm in the BWA aligner version 0.7.15 (3, 4). Post alignment quality control demonstrated an average alignment rate of 98.74% (min: 98.36%, max: 99.22%), primarily composed of alignments mapping to a unique location (mean: 94.65%, min: 93.00%, max: 95.94%). The coverage of the genome ranged from 88.02%-92.08% (mean: 91.15%), with an average coverage depth of 8.60 (min: 5.08, max: 10.26). The aligned reads were then filtered to remove duplicate reads in the data set. DNA copy number analysis was performed independently for each sample utilizing Control-FREEC version 11.0, using default parameters and a window of 5 kb (5). The resulting segment ratios of regions of copy number imbalance were imported into Partek Genomics Suite version 6.6, and data was filtered to exclude identified regions of gain and loss found in control sample. Recurrent regions of gain and loss were then identified to determine regions conserved across all cases and those unique to either moderate or severe groups. These regions of copy number imbalance were then annotated with regards to their proximity to gene content utilizing the RefSeq.

Differentially Expressed Human cfDNA Sequences

The differentially expressed human cfDNA sequences in Parkinson's disease patients' serum samples from The Norwegian ParkWest study were determined employing NGS. Table 1 below illustrates the cfDNA sequences with statistically significant differential levels in PD patient serum samples obtained by methods explained in [00010]. The identified chromosomes that were used for data analysis are known to those of ordinary skill herein from the human genome sequence (hg19—Genome Reference Consortium Human Build 37 (GRCh37) found at ncbi.nlm.nih.gov/assembly/GCF_000001405.13/.)

TABLE 1

| Seq. ID No. | Chromosome | Seq. Start | Seq. Stop | Average Relative Copy Number | Fold change in levels |
|---|---|---|---|---|---|
| 1 | 2 | 37960000 | 37965000 | 3.658 | 1.829 |
| 2 | 2 | 37965000 | 37970000 | 3.658 | 1.829 |
| 3 | 2 | 37970000 | 37975000 | 3.658 | 1.829 |
| 4 | 2 | 37975000 | 37980000 | 3.658 | 1.829 |
| 5 | 2 | 37980000 | 37985000 | 3.658 | 1.829 |
| 6 | 2 | 37985000 | 37990000 | 3.658 | 1.829 |
| 7 | 2 | 37990000 | 37995000 | 3.658 | 1.829 |
| 8 | 2 | 37995000 | 38000000 | 3.658 | 1.829 |
| 9 | 2 | 38000000 | 38005000 | 3.658 | 1.829 |
| 10 | 2 | 89070000 | 89075000 | 4.132 | 2.066 |
| 11 | 2 | 89075000 | 89080000 | 4.132 | 2.066 |
| 12 | 2 | 89080000 | 89085000 | 4.132 | 2.066 |
| 13 | 2 | 95470000 | 95475000 | 5.136 | 2.568 |
| 14 | 2 | 95475000 | 95480000 | 5.136 | 2.568 |
| 15 | 2 | 98125000 | 98130000 | 4.297 | 2.149 |
| 16 | 2 | 98130000 | 98135000 | 4.297 | 2.149 |
| 17 | 3 | 40245000 | 40250000 | 7.275 | 3.637 |
| 18 | 3 | 46160000 | 46165000 | 7.435 | 3.718 |
| 19 | 4 | 5315000 | 5320000 | 8.866 | 4.433 |
| 20 | 4 | 27695000 | 27700000 | 4.963 | 2.482 |
| 21 | 6 | 29685000 | 29690000 | 4.569 | 2.285 |
| 22 | 6 | 162295000 | 162300000 | 8.784 | 4.392 |
| 23 | 6 | 170705000 | 170710000 | 7.853 | 3.927 |
| 24 | 8 | 144750000 | 144755000 | 4.551 | 2.275 |
| 25 | 8 | 7095000 | 7100000 | 1.282 | 0.641 |
| 26 | 8 | 7100000 | 7105000 | 1.325 | 0.663 |
| 27 | 8 | 7105000 | 7110000 | 1.325 | 0.663 |
| 28 | 8 | 7110000 | 7115000 | 1.325 | 0.663 |
| 29 | 8 | 7115000 | 7120000 | 1.325 | 0.663 |
| 30 | 8 | 7120000 | 7125000 | 1.325 | 0.663 |
| 31 | 8 | 7125000 | 7130000 | 1.325 | 0.663 |
| 32 | 8 | 7130000 | 7135000 | 1.325 | 0.663 |
| 33 | 8 | 7135000 | 7140000 | 1.325 | 0.663 |
| 34 | 8 | 7140000 | 7145000 | 1.325 | 0.663 |
| 35 | 8 | 7145000 | 7150000 | 1.325 | 0.663 |
| 36 | 8 | 7150000 | 7155000 | 1.325 | 0.663 |
| 37 | 8 | 7155000 | 7160000 | 1.325 | 0.663 |
| 38 | 8 | 7160000 | 7165000 | 1.325 | 0.663 |
| 39 | 8 | 7165000 | 7170000 | 1.325 | 0.663 |
| 40 | 8 | 7170000 | 7175000 | 1.325 | 0.663 |
| 41 | 8 | 7175000 | 7180000 | 1.325 | 0.663 |
| 42 | 8 | 7180000 | 7185000 | 1.325 | 0.663 |
| 43 | 8 | 7185000 | 7190000 | 1.325 | 0.663 |
| 44 | 8 | 7190000 | 7195000 | 1.325 | 0.663 |
| 45 | 8 | 7195000 | 7200000 | 1.325 | 0.663 |
| 46 | 9 | 69680000 | 69685000 | 4.481 | 2.240 |
| 47 | 9 | 69685000 | 69690000 | 4.481 | 2.240 |
| 48 | 9 | 40815000 | 40820000 | 1.116 | 0.558 |
| 49 | 9 | 40820000 | 40825000 | 1.116 | 0.558 |
| 50 | 9 | 40825000 | 40830000 | 1.116 | 0.558 |
| 51 | 9 | 40830000 | 40835000 | 1.116 | 0.558 |
| 52 | 10 | 119940000 | 119945000 | 4.837 | 2.419 |
| 53 | 11 | 106580000 | 106585000 | 5.750 | 2.875 |
| 54 | 11 | 119610000 | 119615000 | 4.945 | 2.473 |
| 55 | 12 | 38150000 | 38155000 | 2.653 | 1.327 |
| 56 | 12 | 38155000 | 38160000 | 2.653 | 1.327 |
| 57 | 12 | 38160000 | 38165000 | 2.653 | 1.327 |
| 58 | 12 | 38165000 | 38170000 | 2.653 | 1.327 |
| 59 | 12 | 38170000 | 38175000 | 2.653 | 1.327 |
| 60 | 12 | 38175000 | 38180000 | 2.653 | 1.327 |
| 61 | 12 | 38180000 | 38185000 | 2.653 | 1.327 |
| 62 | 12 | 38185000 | 38190000 | 2.653 | 1.327 |
| 63 | 12 | 38190000 | 38195000 | 2.653 | 1.327 |
| 64 | 12 | 38195000 | 38200000 | 2.653 | 1.327 |
| 65 | 12 | 38200000 | 38205000 | 2.653 | 1.327 |
| 66 | 12 | 38205000 | 38210000 | 2.653 | 1.327 |
| 67 | 12 | 38210000 | 38215000 | 2.653 | 1.327 |
| 68 | 12 | 38215000 | 38220000 | 2.653 | 1.327 |
| 69 | 12 | 38220000 | 38225000 | 2.653 | 1.327 |
| 70 | 12 | 38225000 | 38230000 | 2.653 | 1.327 |
| 71 | 12 | 38230000 | 38235000 | 2.653 | 1.327 |
| 72 | 12 | 38235000 | 38240000 | 2.653 | 1.327 |
| 73 | 12 | 38240000 | 38245000 | 2.653 | 1.327 |
| 74 | 13 | 53685000 | 53690000 | 3.635 | 1.817 |
| 75 | 14 | 34815000 | 34820000 | 6.120 | 3.060 |
| 76 | 14 | 106780000 | 106785000 | 3.412 | 1.706 |

TABLE 1-continued

| Seq. ID No. | Chromosome | Seq. Start | Seq. Stop | Average Relative Copy Number | Fold change in levels |
|---|---|---|---|---|---|
| 77 | 14 | 106785000 | 106790000 | 3.412 | 1.706 |
| 78 | 14 | 106790000 | 106795000 | 3.412 | 1.706 |
| 79 | 14 | 106795000 | 106800000 | 3.450 | 1.725 |
| 80 | 14 | 106800000 | 106805000 | 3.450 | 1.725 |
| 81 | 14 | 106805000 | 106810000 | 3.450 | 1.725 |
| 82 | 15 | 84855000 | 84860000 | 3.840 | 1.920 |
| 83 | 15 | 84860000 | 84865000 | 3.840 | 1.920 |
| 84 | 15 | 84865000 | 84870000 | 3.840 | 1.920 |
| 85 | 17 | 41535000 | 41540000 | 5.425 | 2.712 |
| 86 | 17 | 43590000 | 43595000 | 4.612 | 2.306 |
| 87 | 17 | 34670000 | 34675000 | 1.143 | 0.571 |
| 88 | 18 | 19790000 | 19795000 | 4.416 | 2.208 |
| 89 | 19 | 19885000 | 19890000 | 3.685 | 1.842 |
| 90 | 19 | 52135000 | 52140000 | 0.216 | 0.108 |
| 91 | 19 | 52140000 | 52145000 | 0.216 | 0.108 |
| 92 | 19 | 52145000 | 52150000 | 0.216 | 0.108 |
| 93 | 22 | 17235000 | 17240000 | 4.942 | 2.471 |
| 94 | 22 | 24275000 | 24280000 | 0.925 | 0.463 |
| 95 | 22 | 24280000 | 24285000 | 0.925 | 0.463 |
| 96 | 22 | 24285000 | 24290000 | 0.925 | 0.463 |
| 97 | 22 | 24290000 | 24295000 | 1.083 | 0.542 |
| 98 | 22 | 24295000 | 24300000 | 1.083 | 0.542 |
| 99 | 22 | 24300000 | 24305000 | 1.083 | 0.542 |
| 100 | 22 | 24305000 | 24310000 | 1.083 | 0.542 |
| 101 | 22 | 24310000 | 24315000 | 1.083 | 0.542 |
| 102 | 22 | 24315000 | 24320000 | 1.083 | 0.542 |
| 103 | 22 | 24320000 | 24325000 | 1.083 | 0.542 |
| 104 | 22 | 24325000 | 24330000 | 1.083 | 0.542 |
| 105 | 22 | 24330000 | 24335000 | 1.077 | 0.538 |

Note:
Copy number is the average copy number in PD serum samples assuming the copy number for control samples as 2.

Example 2

Measurement of levels of a combination of many cfDNA sequences in serum from patients can assist or improve the accuracy in distinctly differentiating between a potential PD patient and a healthy individual. A serum sample is obtained from blood withdrawn from patients suspected of PD. The serum is used for total cfDNA isolation and enrichment. This RNA would then be tested using NGS or quantitative real time PCR to measure the levels of any two or more of the 105 cfDNA sequences mentioned in Example 1. Detectable levels of any two or more of the 105 cfDNA sequences confirms the patient has PD. If desired, other sample fluids may be utilized, including plasma, venous or arterial blood, or CSF samples withdrawn by lumbar puncture. Such plasma, blood or CSF samples are processed as above. It will be understood that measurement of more than two cfDNA sequences in combination or a set of combinations used in a test matrix may desirably increase the accuracy of PD diagnosis. Similarly, practitioners of ordinary skill herein will further appreciate that shorter DNA sequences within any of the identified cfDNA sequences may desirably be utilized instead of the entire cfDNA sequence. These shorter DNA sequences are preferably unique to the SEQ ID NO. in which they are found, and may have lengths on the order of about 1000 bp, 900 bp, 800 bp, 700 bp, 600 bp, 500 bp, 400 bp, 300 bp, 200 bp, 100 bp, 50 bp or 25 bp.

Example 3

A microarray tray is provided containing labeled nucleotide sequences that are antisense to selected cfDNA SEQ ID NOS. among cfDNA SEQ ID NOS. 1-105. The labeled antisense nucleotide sequences may be antisense to shorter DNA sequences found with the selected cfDNA SEQ ID NOS., which shorter DNA sequences are preferably unique to the cfDNA sequences encompassing them. Alternatively, the microarray tray may contain labeled antibodies that specifically bind selected cfDNA SEQ ID NOS. among cfDNA SEQ ID NOS. 1-105. The labeled antibodies may specifically bind shorter DNA sequences found with the selected cfDNA SEQ ID NOS., which shorter DNA sequences are preferably unique to the cfDNA sequences encompassing them. The term "antibody" includes both polyclonal and monoclonal antibodies. The phrase "specifically (or selectively) binds" refers to a binding reaction between two molecules that is at least two times the background and more typically more than 10 to 100 times background molecular associations under physiological conditions. Specific binding is determinative of the presence of the DNA or cfDNA, in a heterogeneous population cfDNAs. Thus, under designated immunoassay conditions, the specified antibodies bind to a particular DNA sequence, thereby identifying its presence as well as the presence of the cfDNA encompassing it. Specific binding antibodies may be characterized by having specific binding activity ($K_a$) of at least about $10^5$ $M^{-1}$, $10^6$ $M^{-1}$ or greater, preferably $10^7$ $M^{-1}$ or greater, more preferably $10^8$ $M^{-1}$ or greater, and most preferably $10^9$ $M^{-1}$ or greater. The binding affinity of an antibody can be readily determined by one of ordinary skill in the art, for example, by Scatchard analysis (Scatchard, Ann. NY Acad. Sci. 51: 660-72, 1949). Methods of making antibodies are well known to those skilled in the art (Winter and Harris, Immunol. Today 14:243-246 (1993); Ward et al., Nature 341:544-546 (1989); Harlow and Lane, supra, 1988; Hilyard et al., Protein Engineering: A practical approach (IRL Press 1992); Borrabeck, Antibody Engineering, 2d ed. (Oxford University Press 1995); each of which is incorporated herein by reference).

Example 4

Many neurodegenerative diseases are closely related to each other when it comes to symptoms as well as pathological markers. The circulating diagnostic markers for one neurodegenerative disease can be useful for diagnosis of other disease. A method to diagnose other neurodegenerative diseases like Dementia with Lewy body (DLB), Amyotrophic lateral sclerosis (ALS), Alzheimer's disease (AD), Multiple system atrophy (MSA), CorticoBasal Degeneration (CBD), Progressive Supranuclear Palsy (PSP) can also be developed using similar cfDNA sequences measurements of candidates mentioned above. Disease specific kits can be developed similar to one mentioned in [0014] with various combinations of DNA or cfDNA sequences listed in [0012] and [0013].

Example 5

The absence or presence of one or more combinations of DNA or cfDNA sequences in PD patient samples as compared to control samples can be used to develop disease specific kit as mentioned in [0014].

Example 6

The function of the cfDNA sequences which may cross blood brain barrier depending on the size of molecule is poorly understood but a disease specific sequence can be targeted for understanding PD etiology and to target them for therapy.

Example 7

Small nucleic acid molecules derived from cfDNA sequences mentioned in [0012] and [0013] will be designed to therapeutically intervene by specifically targeting genes in PD brains to achieve complete or partial remedy.

SEQUENCE LISTING (105 sequences)

SEQ ID NO: 1 - DNA, 5001 bp, Homo sapiens
gaacaaatatcatgaagttgaactttgaaaaataatgattgtagtggcattaatgatacaaacaaatggcctgagactgaactctgaagtgatcaacaaggtaacttgcgtatgaatgtgcacatcttgaatgatgctgtgtttacgtaaactaagtctaaagtatcaaaaaagcaattacatttagagcattacataatatagaatttcattaatctgaacagttgtcccaccccttagtctgaattagtgaggcttacttgtacataaaataaagggaagaagtttaatctcagcctccaaatccagttcactctggtgctttcaagcccctgaaagtttccacatgtgcacaagtagcagaccttcgcaaaatttaaaactgttagtttagattcagtgaatcagctatggttcttagtttccttcagtcattcctacattcttcccgctttccaaaggttcttttatttttctagtacatgtattttaagtgggtttctctgtttgtttgattttctgtttttaaaggttacatttggaaggtctcatacacaaacattaataaaagtgatggagaacagatttaatggcatgcaacctgagagtgttaattagcatgagaatgcttgctacgtgccaagaaagctgtgttcaatgccagtgatacaaagatgaatatgttcccagaaaaaaagacacataagattgtggaagattgtaattaaaaaaaaaaaaaaaaaagcaagattttagtactggggagcatgaagatggaagttgaggaaggttcagtgaggaagtaacaattgagctgtgtcctcaagattgagtaggagttgtttagggtgggaggatcagaaaggtagtctcattaaagagtaccaaaatcttggtgtatcagaggctcatcaagggactcagagcttggagcagaagttgccaggagaaatggcagatgtggctttccgtggaggagggccttctatgccattataaggaattagggttttatcttgaagccagtggtttgtaggtttgattgtttggttttgatcaacatgcttccttttcaatgaaaaattcaagccctcaagtgtaaaagagatggatgcagagcagattcttagaagttgaaagagggagcttgggattcaatcttctcagcccctcaggctccccacagaaggccatctgaaagccaaacaagaaggaaatggggactgcactgtaagcctagaagtggtccagtgctgtgtgtttctgtttctgaaaggtcaacctgtcagcactgtggagttgggaacaaagacagacaggaaacagggagacccactgggccctgatgctagggcctgaagaaagcatctcaccatgggcacaggcaggaggtgtttctaaagctggttaattaactagggggaagtgaagcatacattggggatgatcccaagttttcttccagatgctgggaggaaggcagtgagtgatatggtagcttccaaattcatttaacaacaagaatgtggctattagattctgagtagtttcattctaatacaagactctgcaaccaagtttgaaatgtgctgaattctcatgaggaaaggagatgccatgattagagaagtcatttttaagatctttcctgttttgggatgtgggaagttttctcagaggcaagtttgatactgaatgagacctaacagttgttttaaatatatccctggaccctcagtttcattcctgatgtttaatccgtaattagtgggagacaaaaactctaatactgtcaaccaaatttgaactaccttttttgctgcaaatgtttcttgaggtgtacataaaaagtgtaaattaccatcctttaaaaaaagtctgaaaaacttcaaaatacatcttattacatggaagatgtgttggcagtttgggtcttacagcctccaaaataaagacctctgatggaaaacattacttaatttttgtcggtgaactcctggaattcatattcacaagggagtaagaccattcgatttccagaaacaagggtgtggctactcttgtctcccacttctcatgaagtgcaccctttgaattagaccaagaaaaaggggagcatgaagcagctttgtttcttccttagaaggagcaagtttgaagccataaagactctattttcgcactcaggaactaactgctagctcttttctagctagctggagtgagcgccagcactggggtatcctagcgtgaacaagaatgctattttggtctgttgtaaagcattgtggaatgcagattttagatcatttcatcacatctaccagcaaccacaaaacaaacgttatttcagaatgaagactatggatgtagaagtactaagagctaaataaaaagaagattatagagacatttttaaagtttaatgaatatgctcactaccaaagctttgctttaaaaagaaaaaacaaatacttatacgcagtgttgggtgtttatacagtttgataaaggccaggtgtagaggaggcattgaagaattccactgcgtctctcattgaaccaaagtgagagggggagcacagaacagtctattacgagtaataccaaaccatcttccctaaaaaaaaaaagtaaaaacaaggatcctgtttatccggaagaagtcacctagagaattcagtaatttcaagataattagattccttccagagagctgaatgcaggtttcacttttctctggagaatatggccactttcagagacaattaaaatgcttttaagtgtggcaacacagtccctggagaggaagggggcttcataacatgacccaagtggcagctgatgctgctcctctgactcagaatatcctgtgtgtgtgcagacacttaatctttgtgtctttctctggactttgagtaggaaattttagtcaagactctctagagtactttctattcatgaaattaaatgcttgaaggattctatgatttatactaggcattaaactttacttccattcacagtcccattagttttaatgagttaaggactttgctttacttaaagtaaacaaatagaaatactccaatggcaaaggatattggactaaattcccctggtcctggtgtattcctcccatctggtaccctcctgcctgaaatgtcatgattgaagatccattcctttagcttaaatattgtcctctctcttttaattttaatctaaatctggattaattttaatttgaatctgggaggaaaggcacattaaatcccttgtgtgaactagttaatccttttaaaaaagttagaaagtctgaaaaaaaacaagaattggtaaggatgcagaggaatagccactcctatacagcaacttctactttttttgaacagtttggggccaggttcagtggctctcacttgtaatcccagtactttgggaggcctaggtgggaggatcactcgagcccaggagtttgagaacaatctgggaaacatggtgagtccccacctctataaaaagaaaagaaaagaaaaattagccaggtgtgatgaagaacacctgtagtccctgctactcgggaggctgaggtaacaggatcactggagcccaggagtttaaggttgcagtgagctctggctatgccactgcacttcaacctaggtgacagagtaagaacttgtttcaaaaaaacagtttgagaaattccaattctggcctagatggagtaatagggactgaaattacctgcctgaaacaacctaagaaaaatctgataaattagatgaaattatgtttttttaagacaaggaacatcacataatgaaggaccgagatccctgagggctgagaaacaaacaaggtgagccttacaattattctagcaattgccttgaaagagtttccaggtgtattagtcaattttcacactactataaagaatacctgagactggataatttataatcaaagaggtttaattgactcagttctgcatggttgggaaggcctcaggaaacttacaatcaggcaaaaggcaaaggggaagcagggcatgacttacatggcggcaggagagacagcatgcagggagaagtgccagatacttatcaaacaacgagatctcctgagaacccactcacaatcacgagaacagcatgggggaaaccacccccatgatccaatcatctcccaccaggtccctccctcaaaatgcggggattacaattcaaattacaattcgagatgagatttgggttggggacacagccaaactctatcaccaagcaacatcacagggaggggtagcccaggaagagctcaacagactacctgaattgaagagatagagttggtagtctgaggagacttgagctgatagggcagggtcttgaaggggagctgcacagggggagaaccatggagatctctggaggggccctttcaactcaacagagtactgaccagcacctgtgtgtggagagactactcaaagccagctggggaaaaaactatctgaaaggattagaaggaacgtactcacactcacaccaggctgatagtaatgcctgcttctaccagccagactggaaatcttcacaattcacaggatactgagtagattattcagaagggtcttcccttcacagtgggaaataattatctctagactacatttttctggccctgtctaacaaatctttaaagcaagacttgaaaggatcaaactgtttttaaacaactcaactgtgtcccagaacaaagcccaagaatatttatgggcaatacaaaaatatccagcaccaaacaagataaactcacaatgtctggcatccaatcaaagtatactagtcatgcaaagaagcaggaaaatacaagaggaggagaaacagacaccacttcttgatgtgaagagtgttgaagaatttgagaacatgtttaaaaccactggaaactcatcagtgacaacattgctagtaaggtagaacttaatatgat

SEQ ID NO: 2 - DNA, 5001 bp, Homo sapiens
tacatgattcatcagattatataccaaaacccaattatttctttcctatggattctaaactttgtttttccttttattcagggaggaaagtgatttttgttcttgtggatgattgcagagatggccacatattttgcagccctgtgcctctaccctaataatggggaatcttcatttccatgttagatttgtggacctagcatggtttttattttggattgtcttgttcagcagttgtaattgtacaagtatgttagggcccatcttgttgaccctggtagcacgatttaggcttacaacaactccaaatgctattttgggtctttgggtttaaagacaacagaaaccaggcccttgttcttaggagctcaccatccttctctgcgaccatagcagattcccagttgttttaaactgtacctggaattttgatattgttcaggtatagtgagaccaaaatatcaggagacaatggccattaaaaagatagtttgtaacttacagctcccaagaagggcatgccatgtcacaggggtccacacggggaagcaccagggttggtcaggaggcagaaggagccaggagaaaacataggcaaagccttgcttgtggttttcatggaaagaaaaccagccagactggaaatcctcacaattcgcagggcctgggtagattattcagaaatcttacctgcacagtggggagtataattatctctagactacatttctctggccctgcctaacaaatctttaaagcaagactttaaagaatggaaagaatgaatgaagcaaggtacgcagctgagcaggcttaggggatttgaataatctctgcaagctctggcctatctgagtggctcctcgttgtgtcttccctggccctgggatgcttaaggcggaggaatattgccctcttggaatgtaagacccaggtaaaggggcaggtgtgagtatagactcaggattggttggcttgcacatcaaagacatgctccaaggcaaatgtttaccatctctaggaattagttaaccctgggaggtcagtctctccgtggtcagttgaaccccaaatgtcagagcatcagaaatacagaaaataagaaaatatagttaaaaatagttacttcactaatacgagcctcagtgaggtcacctgtggattcaggcctgtttgggtgcacttggtggattgcaagaggcagcgtctcagagctctgcttacatggaagagtgaaaggaccacctgagactaaaaaggtcgaaaagtaaagacagctgtggtctaccaccttgtttaagaagagtatgggcctattagaagagagcagtaatttgaaataaagcttgaatccagcctagtctccagcctgggccttagagccactgggaaagctgtttctctatgaactcacataagatacaaagaagctgaggcatcagcatcaccgatggcagccactgcagaggaacttgcaggtcccaccacctcagctcagccaccagcacgtcatcagggcttcgcactgacattgcagtgacagcagacaacatcaatgatgcccttgctaggtaggagcagctgtggtgatggcattaatgggcaccaagggacagaactgacgcttttcttcctcagcaatgactagaggcattgccacagcaaaaggagggaaaaaaaggccactactgtgacacttccaattctggccaagatggagtaatagggactgaaattacctgcctgaaacaacctaagaaaaatctgataaattagatgaaactatttttcaagacagggaacatcggataatgaaggacagagatccctgaggaatgagaaacaaggtgagccttacaattattctagcaattgcattgaaagagtttccaggtgtattagtccattttcaccctgctataaagaatacctgagactgaataatttataatcaaaagaggtttaattgactcagttctgcatggcttggaaggcctcaggaaacttacaatcatggcagaaggcaaaggggaagcagatcacgtcttaaatggtggcaggagagacagcattcagggggaagtgccaggaggaaaaaagaaaaaaaggacactactgtgagaacttgttctcagagttcaggtgagacatcagggacacccagaattcttttcaaagaatctgagggcaggtagacttcacccagagcagatggtggcaaagccagggcaggcctgtcccacagctggtatcattaccctgttctcacatccacatcggggaagcctgagcacctccttggttctccacctagagctccaggatatatccttgaggattgctgtttgccactcaggaatttatttggaggttatcattttgatgataatctttaaaaaagtcagatctctactcaccatctggatgactacatcatcatgaaataccactacataattcagtgcttgcatttgtaattctgttttctgtttatgctagcatcaaatagaggataaagacatagcatactgcttgaacgtagattttgcagtagaaaaaggagtgggagaattgagctagtcaatgctggtgatgatagaggcatgctgagctgaactagcactgagctgtgagtagtgtattcatgtatgtggtgaacagatacattacccagaccgccttgttgttcagaccagcttgcagtgaggaggaaatacacaatggaaaatgttctgtttctgattcacaccacagttagttgcattagattcccataaagtgcaggtttcaaaaattcctctaatgtagcttcatctttgaatatataaggcagccatataaggtcaacaaatggcaaatcaacaaaattcgcatttgaggcttgtttactgacagaactttttaaaattgaatttgaggtctgcttatcttgaactagaaaaacaaaacttttgtgttttgcaatttcttatagtataattgtcctaataaatactcactacagtagctttctgaggtcaaaattcaggaacagaattaaatgtagaagtggagccaagcctcctacttctactcctaaacctcattttggtcattttgcttatcaaaataacatcatcggtcccattaaattgctattattaattaaatagtgtgcttttgtaagtctatattaactttgaattgttttggttctatggttgtataagaaataaaggactttatacctagatttatagttgtatacacttcagtaatattataataaaatatagcattgagaatctgtaagaatttttcctttttataaaaggtctatttgcttcttaattttgagaaatccttgattagcaaaatgaagcaccacatattccactacatattgacctagatttctgccattgttcaacagcatacattacttcaacacaattgaaatttatccccagacttctttaacctgtaattaaatcttttattttttctttcgtgacagagagttgctctgccgcccaggctggagtgcagcggcatgatctcagctcactgcaacctctgcctcctgggttcaagtgattctcctgcctcagcctcccgagtagctgggattacaggtgtgcaccaccatgcctggccaatgctttttgtatttttagtagagatggatttttgctatgttggccaggctggtcaattaaatctttaatattcagactaccgaagtccaagcccctttctcgaatgaggcatgccttcttttactgggcagctgactgttgtaagttctgggatgcctggagctggcgtgtccttgttagttattgcccccagccacaggtgttcccagagcactggtggatcccattatgaggactggcctgtttttcaagtgtccaaagcacagttaagacaaggccctggagtttaactgaaaaaataaggatagtccgagaacaacagagagtaactgatatgttttggctctgcgtccctactcaaatctcatgtcatgttgtgattcccagtattggaggaggggcctggtgggaggtgactggatcatgggggtggtttctaatggtttggcaccatccccctagtgccgtcccgtgataggttctcatgagatctggtcgtttaagtgtgtggcaccttcccccctcgacccatcatgtagatgtgcctgcttccctttcgccttccgccatgattctaagtttcctgaagcctacccagaagcagaagccagtatagcccgcagaactgggagtggattaaacctcttttctttctaaattaccgagtctcaggtatgtctttacagcagtgtgagaatggactaatacagtaacatagttaataccaccagaggtttcatttagggcttgcagaccaattcctgacctctgagctcccactcccctaccccagctctctgacttgtccctagaagccctgcccagcccccactgaacctctccaggcctctctccacctcacaggcctggtctccagctttcttcctatcacagaatgacccagagtgcaaacgtccatctcctcccgggaaactcctgccactacccagatggtgagctctgccctccaaatgctggcttatccagtcttaaatcgcacttcatgtgctatcccaactgcacagctcccatccatattaaggggcaaaaaaagtggctctaattctgcaaggatatagtcatcttaaaaatacattccatttatattacaaaacagaacttaataaaaggtctgcagcatctacatccgggtttataatagcttcaattttctccaagaaaaataaaagcacgtgttttatatttgtgaaattaatgtgccctttttggtcctttccacccaaatatagaaaatctgctccaaaagtgaattatattatatctaaaatttctaaaataatgacaacaataataataatgaaaaacaaagtatcagctcttttggatattatagtgaataagg

SEQ ID NO: 3 - DNA, 5001 bp, Homo sapiens
gaaaagtttttttaaatgcaaaaataatatcaaacgttcaaaacctatttgtattttgtgacaatataatatagcagtggaatctatgaaccctgattccaggtctagaatcagactagctgggatttaagatcctggctctcctattggctagctgggcaaatgacctgaactcactgtgttttcctatcctcatctgtaaaatggggttgacagtacctccctcatagggttactatgaagatttaaatatataacagcttaaaatattgcccactgtataataagtactcagtacatgtgaactgtgatgatcataatgatgatgataatgaagacagtgatgatggtagtggcagtgatggtggtgatgatggctgggtatctgaaggcagttaaaaaaaatcctagaaagagttccaatttgtgcttctcattatcatcattggtaatgaacatgaatagtggacattctcttactcttcagtgcccttttatccccaatgtggcttgtgccatttaaagtacaatgagggactcagaagaagctatggttgagccaatcgaatctttctgacccttcttacttttgtggtgacagtcacgttatcaggaactctagtgagcacagttctttgtggttcttcatgcaggtttagcagggcagagcagtgtcaagctccaggtacgagaggagaagtctgaggaggaccatcaggctgggagactgcaggggacagaaagttagagggactgtgaggtgagggggccagaggggagggtcttcagatcataaggtgagcagctgaagaacttccccctgaactctcagaagataaatcctcttgctatggctcccccaaactccctggctgtatggggtagggtagaagtccaggctctgggagtctggccttggctgcgtcttcagcgggctgcgaagctgttaatcttcttattcatctctctggacactgctggtgggaagtagagatgagatttcttttcttgatctctgtcccttctgcttccactccccaccttacctctaggaatcttttctgctgtcagctcccagaagcaggaaaggaatccccaaatcagaacttctccttgggcccccatgatgtcacagctcagtggacaaaaaagatattcgtgacagggtcactaacctggttactcattcagtcaatgatatttcattaagaaagcttaaagtggttaacatcatgagtccccaaaagagcaaacttaagtgatcctaaagcgtgtcactatattcatttataattatgaaaacaaaatactgtggccaaaaatgctttgcgattttgaagtaaaagatgctgtctaagcatttctgagtgctcaaaatgtatcctttatgttaaagaaatatgaattaaatataaatgatagttttatgacagtagagcaaatggatatgttttaagaaggaatgaatgaccaacatttattattattattagtttaatgtttgcatgatggcttgcatatttttgaaacaagttatttagtataaacattaggcagtttatatttactgtatttactgtttgctttatcaacaggtagaaggtcttgagttcgctgacgttactctcaaaatactttcaggtaattgttgtcaaacaagagttgacaatttgcattttcttgattactaatggtgagtattttttctttttattttattttatttatttatttatttatttttatttttaattttttttgagatggcgtctccctctgtcacctaggctggagtgcggtggcatgatctcagctcactgcaacctctgtctcctgggttcaagtgattctcctgcctcagcctcctgagtagctgggattacaggtgcacaccaccatgcctggctaatcttttgtatttttagtagagacgaggtttcaccatgttggtcaggctggtctcgaactcctgacctcgtgatctacccgccttggcctcccaaagtcctgggattacaggcgtgagccaccacgcctggccatgatgagtattttttctaagtgaaataagccaggtgcagaaagacaaatatcatatgtttcattcatatgtgggagctaaagaagttgatctcatagaagtagaaagtaaaatacaggaggctgggaagggtagtggggaagagggacagggagaggttgattaacaaatacaaaaatatagttagataggaggaataacttctagtatcccatagtatagcagggtgactataattaataatttactgtgtatttcaaaatagctggaagagaggatttggagtgttcccaatacaaagaaatgataagtggttgagctgatagatatgacaattaccctgatttggtcattacacattatatgcatgtactgaaatattacatatgccctataaatatgtacaattattatgtgtcaattaagaaagaaaaagaaaaaaaggcttatctcccagtgatcacagggatgaggaaagaaaaacacaattaaatttaaaaaaagagaaaaaagactatgaaattaacttctcagctcacatctgtgttgcatgatcatgagatagaaaaccatcttcccatcagtgttttggagcaccctaaggcccccccataaagttcacaggccacctctcccacctttcagataccccaccttgccagccttcaagatttcccccaagctctgcaggttctcattgaaacactcaaatactttattatttattggaaaaaaaggaaaatatgagactggcctcaccattggctttcattttcctcttccctctcctccctaccttctgggttgtggcagctgtaattgggttaaactttgtgtaattccgaagctatgctcatagaaaaaaatagtgaaattctctagcgcacctactaatgacccaagaaaaactggaagctactatagactttttttttctttttctagtttctggaactcggggctgattcttttgagatgcataatttagttggagccaattgatgaaggagtcagttcttatttaaggaaactgccttcaagctcaagtagaaatcttgagacccagtatgaaatttccattttcacatagcatactataaaaaattgtctgtttttaaaaatgaacttatgtaaagacagtcaatctattcagtttatggctttctttttttttctaacttcaaaccaaaggtgttttaattcccatagaaaagtattaacaaacaatggtgactaacttcattcttataattagccttttgtggttgcaaaatgtcttcacatgctttgtttttttacttggtcccatgacagttctttaaggtcactgggacctggactcccacttctatttgatgcctgaggaaactgaccatccaaagcaaagtaggctacccgagatcatgtggctgttaagtggtgggtctgggatagggctcatctttcaaccaaaaataattattcttaattaatggagtacaatttgcagtgatttggtacttgctttgtagacatacaaagtttataaagtctcagaaatttgaggatgcagtgggaactcacctttggaatggggtggaaatgggctgagacctccacgaataggtggctgtttacaaactcagacccataatgcttcctcccctgaagaggtttcctttcctgctcctactgggatatactgggacctgactggctcagtctccctcctttagtttttcaaatctgtatatgacaatcttaggcagcaaaatatatttcaggtggtgtggtggttcattcctgtaatctcagcactttgggaggcccaggtgggcagattacttgaggtcaggagttcaagaccagcctggccaacatggtgaaaccctgtctctactaaaaatacaaaaattagccaggtgtggtggcacatacctgtaatcccagctacttgggaggttgaggcaggagaatcacttgaacctgggaggcggaggttgcagtgagccaagatcacaccactgcactccagcctggatgacagatagggactccatctcaaaaaaaaaaaaaaaaaaaagcttcaggtcaaaggctgggttaggttatttgccagacaaacaataatgacaaataaccttggaaaagaaagtatgttaatatctcttgttcatgatgtcagggcaagaacacaagccctaggggccgacagcctggcttgcccccggccctgctggtatttgcagaacgaactcaggcaactcactttgctgtgccaatcctgtttcctcacctataaaatagggctgtaccttcctattctattgtattcttatgactattaaatgagatttcatgggaaataatactgataagcagagttgcttaattgatgcaggttctccctgtactttacagacttggctcttgaatatctctcattgcctccgaaagccaaatacatagttgctcactgctgaaatgatgaggtccctatgttctgctcaccttgcctgaggacacgtgcagtttttccttcccctgataggcggcctcagcagcctatcagtgcaggggcaccttttcctggggtgcacacagtcggagagtagccaaccttcaaaaataattattgaataaaagaacagagatggcctgagtgttaattcataacacaggacccccctcaagtgggctctgtaacatgatgattttatttatattttgttgagggccaacaaggaatatgagtgtcatttaagcctaatccaacttagaggtcactatttcctacatcctcagctgcgagtttagagaccatattgggtggcagcaaaagagcagtttcaacctgggcctcagtgaaatgctgaagaaggaagtagagtcaagaaggttgtcttctttaaactttaaaaaggcaggaaacaatggccctgctcagagaaaagatggctacatttagtacatccagggct

SEQ ID NO: 4 - DNA, 5001 bp, Homo sapiens
ttccttcctattgacccaatttttcaagggtgtatcaatgcttgatactcccaataacactgtgagcttttcatcccatcaactacttgcacattcaacaaataactattcagcacctcttatatgccaggcactgtgctaagtgttggtgtgcagtgcccgacacttaaagaaaggcacttcaaggtctttgaattcaactattcagtctctacttgaatagctttattaaatcatttttcagtctccaaaaattaatggtacatcattaaaaacctccaacaaagacctatccctttggtgaagaagaggcaggtctctctggctgctctgaaatgagaaagtctttcttgtacagagcccatttaggcctctggtcctagctccacccctctggagccacagagaataggtttaatccctctccatctgctattctttcaaaactgtgaagacagttatcgcttctccctgagtctttgcttctcaaagccagcattcccaaatctttctgcagtaccacacacatcatggtcccctctgcattctcatcacagtccttctaatccccaagaatggtggacaaagaggaaggaatgactgtctactttggaaaccaggcatgatgataatactctgaaatttctggcaaccacatgaaggagaataggcacagccagggtctgaagatatctaacatatatcaaatgcagaatttggagcaaattaagcggatattaactgcaaggagatggaataaaaataggagcatttagacagaccttcaggaaagtttcccaccatgagcctggactgtgccaaaccccaagcatttggaaaacagcttgagatgttcagcaagtcccaaatgcaagcatttggggatggtttgcgctgtcttaattgtccttgtttccactagagtagcttgacaaggcactcatttgctgaatttcttccagataaagagtggtttcttattcgatacagttagagcctctccccccgccctttttttttcctcttctttctttccccttttctttgttgttggccaaagctcttcccaggagaccacagatttctctcaatgaggactgttttcattatcaggtatgatgagcatattgaggaagttgatttatattcagttagaagtttctctttaagagaagaaaagtgatcatctctcctcttaaagtagctggcacttgtgctgcaaatgtattaaacgtttccagattaaattccagcagagtacagtctatctttgtacagggataatggactacagtgtttagacagacccctgctttctgccatggaggagaaggttcaggtataatgcacagagacaaaaggctgcagcaacccaaacagaagtgctgagaactggctgatacaccagagtcatccaaaatgccctggagactaaggtgaggaggctgcactgagctaaggtagcactcaccttcccaggatcaaaaggtaatatgcagcaaaaaagatcggacattcagtttggccaggccatgctctcaggacatttggtgtgaacatactagtggcggaacaccaagcccagtggcaatgcatccacatgacacaacccctatgagacgagaaaagttctggggatacagttgggagatagtggagaggtcaatgatggaagactggtcttttcttttgacaaattgggggttgtttttaagcagaaagaggacagccccaaatttgccagtgctcattatgcatattgctcactcatgaagaactgagatccaagtaaacttaaaatcatcttgtccttcaacctactgatattcgcaggctaactcaatcacagggcggtctatcagaccttgcaggctgtctaccgaatatcctttcttgtatcatcttgataagagaaccctgattttgttaggggtgggtgtaattgacttacttgtgtcagtttccacgctatacttttcagcattccatgcaagaaggactagctttggagtacagtgttagctaaggaggtataagcagaaatctgtgcggatttccagtaaagttttcttttttcaggtgagggttgaaaccatcttgctcccttttttatcttcctgttttaaatatgactgtgaggctagaatttagcagccattttgtgacaacgaggatgacagccatgcgctgagatgggggagcagaaaaatggaaggagcctgagacttgatgggtctccagcagcagacctagactacctccttctgcatccaccagtcccctcacccacccaccccttctacatccaccagtcccctcacccacccaccccacacatatacacacacttctccacctcaggaaacgcaaccatcatcttccccaaagctctaggagtcatccttgattttcccgtttctcttaccatcccctctactcttgtatattccatctattaccaaattctatcaattctaccagcaaaatagatctaaaattcatctccttttcatgtctgctgctgcttctgcagtgaactctttgacacctggaatgttgcaagagtctcttactgagtctctccacaagggcttggcttcctgcagttacctctacacaacagcagaagtgctttcccaaaacaggcctgatggcatcactcctcactccccacttaacacccttctggctttccactgcattgagtttctcatgaaagccctgaggccctgcattgcagggaaaagaaagagagatcagagtgttactgtgtctatgtagaaaaggaagacataagaaactccattttgatctataccctgaacaattgttttgccttgagatgctgttaatctgtaactttagccccaaccttgtgctcacagaaacatgcgttgtatggaatcaaggtttaagggatctagggctgtgcaggatgcgccttgttaacaatatgtttgcaggcagtatgcttggtaaaagtcatcgccattctccattctcgattaaccaggggcacaatgcactgcagaaagccgcagggacctctgcccaggaaaaccaggtattgtccatggtttctccccatgtgatggtctgaaatatggcctcgtgagatgagagacctgaccgttccccagcccgacatccgtgaagggtctgtgttgaggtggattagtaaaagaggaaagcctcttgcagttgagatagacgaaggccactgtctcctgcctgcccctgggaactgaatgtcttggtataaaacccgattgtacatttgttcaattctgagataggagaaaaaacacactatggcaggaggcgagacatgttggcagcaatgctgctttgttattctttactccactgagatgtttgggcggaaagaaacataaatctggcctacatgcacatccaggcatagtaccttcccttgaacttatttgtgacacagattcctttgctcacatgttttcttgctgaccttctcccaactatcaccctgttctcctgctgcattcccgttgctgagatagtgaaaataataataactgagggaactcagagaccggggccagtgcaggtcctccgtatgctgaacgccagtctcctgggcccactgttctttctctatactttgtctctgtgtcttatttcttttctcagtctctcgtcccccctgatgggaatacccacaggtgtggaggggcaggccaccccttcactgcattacctggctcctggccacctctccaacttctctcaccacccttccctcttcttccagtggctcaaaaccactcattctcactcgaaatgttcctgccttcagttcagctctatttcatccttcaggtcttagcttaagtatcatgaaaatttttctgaccaccgtgtctagaggaaattaccctgctgttgctctcaatcctgacccactcccttcttaacacttttacaacttgcaatgattgaattggcttgcttacctgtagttatttggtttcggacaacagactccactaagacagggtccgcatcttttttgttattttttattcctagtgcctagcttactgcctgggacatagttagagctcagtaaatatttgtgaaattaatggcgaatgaattttatttggatatgatatgatgcagtatatgaaatttttcacttgatagaagtataatatggaaatttctatcacaatgtttattttaagctactgtttagaaatcatatataacatatacttttaagctcatttatttttactttctcacttttcagttgatgcttatgtcagaaaacataatttgagtcatgaatgcatattaagacatagattgaaatttaactttatggcatcaaaatactttcctgaccttgaaatatcctttttttcataatattcttataaaatactttctgaccatgaaatattatttttcatataattcttacaaaaactagattcgcttaatatttctatttctaaatggaaagatcagaaagactttttcagattggaatacaaattccaaagaaactacttctttggaaatcacacatgggtgttgtaaataaacttattcctgggtaacagcatggtctgtggaattagaaaacctggattcaggccgggcatggtggctgaggcctgcaatcccagcacttcgggaagccgagacgggcgggtcacaaggtcaggagatcgagaccatcctggctaacacggtgaaaccccgtctctactaaaaatacaaaaaattagccaggcatggtggtgagcacctgtagtcccagctacttgggaggctgaggtaggagaatggcgtgaacccaggaggcggaggttgcagtgagccgagatcgcaccactgcactccagcctgggcagcagagcgagactccatctcaaaaaagtaaaataaaataaagaaaaaaaagaaaacctggattcatatccagtttttgacagtcatttactatctgtgtaa

SEQ ID NO: 5 - DNA, 5001 bp, Homo sapiens
acatagagcaaactgtgtgccttatttgtgccttaactttctcagcagtactatcgggatagtagtaacatccatcggagagttgtgtaatgtttcaatgagaaaatgcattgtaaacatgtgtcaaagtacttggaatatagcaaacaccacctaattttagatattgtatgagtttcctagagctgccttaatgaagtacaacagactggaggcctgaacaacagaatttaattttctcacagtttgaaggccagaaggactcgatcaaggtgccgacaggcttggtttctcctgaggcctctctccttggcttgtagatagctgcctgctccctgtgtcctcacatggtcctcccttcctgccctctgtacttgtgcctaaatttcctcttttattttttgagacacggtctcactctgttgcccaggctggagtgcagtgacgcaatcacggctcactgcagcctctacttcccaggctcaagtgatcctcccacctcagcctctcaagtaggtgtgacttcaggcatgcatcaccatgcctggctaattttttttttttttttttttcggtagagacaagttttgtcatattgccctggctagtcttgaactcctgggcttaaatgatcctcctgccttggccttccaaagtgctgggactataggtgtgagtcactgtgcccagcttgcatttcttcttataaggacaccagtcctattggattaggacccacctaataacttcactttagtttaattacctctttaaaaaccctatcttcaaatgcagtcacatcatgaggtattaggggctaggacttcagcatattacttttaggggacacaattcagccgttaacactattaatatcattcccccagatcgtgtgtagagtttctttcttcaacactggtttttgaaatcctgcagactttttaatgagaatttgaagagatgaacgtcatcaaatctggtaactggcatattgtgagggaaacttgcggggtgcttgtcttttttatgctcgttatcggcttgtttttaacgtgagtgttccttatacttcctggttttagcaaataatttactaaggtctacttaaattgtgtgagactaagaataaacacaactgtaaactgtgtatgatggtcagaaccaccctggaagtggacggtgagctgagcagagtgtgggtgaaggtgaagccgtagccatccttccccgatgctcaccagcctgcaccctccagggattctcaacctctgtgtagacactctgacccattccaataaaagagaaagtacttcaaaagttatattgccaatttttaaaaagtaaaagtggaaacagatcttcagacccacctttaatggtataggcacactgaaacaccaacaccaaactctgatgttttactctcaacctttgagagatgcaaatctaagctaagacttctctccagcaacagaataactgtttgtaatatatacttgaaagtgaagcatagacagtgtattgaaattcctgggcttgaatcttgccatgtattagctattgggttggtgcaaaagtaattgtggtttttggcattaaacgtaatggaaattggggcaaaaacaggtaattaaaagtaatatttgatggtaagcacatcatttaccctctctgagtctcagtttcctatactataaaattgggaaaataatgtatatttctcttctatctcactgaactcttatgaggaggaagagatataataaagcccttagaaaactataatcaatgaaaatcaatacaacagtcaatacaaatcaatgctgatagtgaacacttatatggtccttactctgctaggtgccattctaagaatttcatatgcatgggttcatttgatcctcaaaacaactctatgaagtaggtactgtcattagccctcatatggctgttgaattagatacacaaattttaagttggcttttaaattcctatagacttgggcttctcaaacttcattgtacatacgagtcccctggggatcttgttgaaaaatgcagagtcttatttagtagatctggggaggggctagagatcttgcatttctaacatgttctcaagttatcagatttaaagatgagttgtatgcatttttcttttgcacacacgaaaagcaaatattctaaatttgctggttctgtgttaaatggctgtcagtaacatgctcattagtgatgtgtgtgtgtcgaggggtgtttgtatgtatgtgtttaaacaatctaacattgagtgttttcagcacatgaaaagatgctcaatatcactagccgtcagggaaatgcaaatcaaagccacagtgagatactacttcacacccattaggatggctataataaaagaaaataaaacaagtgttggtgaggatgtggagaaactggaactctcatacattgctggggacatataaaatggtgcagttactgtggaaaacagattggacattccttagtaagttaaacacagaattgccatatgctccagcaattccacttgtagatatacacccaagagaaatgaaaacatgttcacacaaaaccttatacatgaatattcctaatatctatattgcaattgccaaaagatgaaaacaactcaaatatccgtcaattgataaatagataaacagaagtgatatatccctacaatggaaaattagccataagagaatgaagtactgatacatgctacaacatatatgaacattgaaaacattatgccatgtgaaagaagccagatacaataggccacatattgtatgattccatctatatgaaatatcaacaataggcaaactcataaaacaggctgggcatggtggctcatgcctgtttttattttttaaaaagtacaggtgtttctggtcaactattccctaatccaaggttacaacttactcctatgttttcttctaagaattttatagttttagctcccacttttaggtctatgattcactttgagttaagttttgtatatgcggtgagataggtgcccaacttaacatttttgcagctggattaccagttgtcccagcccatttgttgagaagactagtctttccacattgaattgtcttggtacccttgttatgatggttaaatattatgtgtcacttggctaggctatggaacccagtcatttgtgaaggtattttgtagatgtggttaacatctacacttgattggctttaagaaaaagagataaccctgcataatgtgagtcatcctcatccaatcggtgaaggccttcagagcaaaaatggaggtttccctgagaagaaggaattttgcctcaagacagttatgcagaaattctgtctgtattttgcctgcttgcctgccctacaattttcacactcaaaactgcaatatcaacttttgcctactttgcatgccttttctttcttttcttgcctaattgccctgaccagaacttcccatacaatgtcaaatacaagtggcaagagtggacatgcctgtcttattcctgatcttagaggaaaagcttttaatctcttaccattacatatgatttagctgtgtttctttttgtaaattctcttcatcaggttgaggaatttccatcctattcctaatttttttagtgtttttataatgaaatgctgttggattttgtcaaatgccctttccacatctattgaaatagtcatgtggtttttgcctcattttactgacttagtgtataagagaggttgatttttatatgttgaaccactcttgagttcctgggataaattccacttggtcatggtatataattctttttatatttgctagaaacatacacgtaccctaaaaaccactgtattaaaagcatttagcaataaaccaaccaaataaaaaagaaacaaaaataaagtccctcagataactttgtaaattgaagatgtttttgtaattttaagaaattattaagtttggaatattgtcagatacagtacatctgaattgaccaaaaatgactaggtcattctgatgaatcaaactttattagacaagcaggattcaatatggcttatataacatctttgaatttctgccataatttcaaatattacattcttttccccattgcctgcacttccatttgctgcctccaaatccctgtggggtaggggctattagggatagtgcagagttggtgggcatggcatatactctggattaccctaaaaatgcagcattttagggaaggtaagtccagcaagtagaggcaagcgcgagccaggcattatgtgtgtctggttaactcagctgttaatcatgcggacttgtaggctgtggggtcagaaatcccttaaatcactcaatttttggccttaaacccagccacttcagcacagaaatcattgctcattttcacttcggattaccagttgctaattagcttccacaattgtcttagatgtgcaattgtattcttgtggcatttttggtaaggagatccatttatttggagtagaatagctaaatgtacagagaaatggagggctgttatagaaccttggtcaagtgtgaaggacttcaaagtgcatgtaaaattcacttaatctgtgccctttaaatgtgtttcaaaggagatgacttctcaacacttccatcttttctcactgtccccattagcattataggtctctctaccaagaagtcttccttaagtctgaccagcctttctctcttgttctatcatcagtggagatggagaacagctgctctattttatggcctcactgttactttaatttatatctgctgtaaacaggattgcttaaaacttaatagaacatttcagttaggcatgtagaaaggaccctctgtcttgccccagtcattcccaatagatgtagtttattgccttaatttatgattttgtttctgttgttgttgcctttttttggtaaatagcatgattttattttta

SEQ ID NO: 6 - DNA, 5001 bp, Homo sapiens
atgaccatattcttcctaggaattctctgggcacatggtgtttcaaaatcttgctaatttaaagacccatttcacagactgagagatgatcttgataagataataaaatgaaagtttaaggaatacctcatggtctcaaggttggcaaagactcaagcattgctattgcagcttctcagaagtgatgtggatggagctcatagataaagggtctgtagctagatctgtgtatctaacattactgctggtattttacacaagtgagaaatatctaaggggaaaatcctggcatgaagtggagtgcttctttccctttcgatgcctttctgctttggccaaagaatggagaagtcttttgtaagggaagactggtagcttctacccactgatggcactgacctgtgacccagagagcaaggattaaaaatgtagaaataggcatatgatttctcagagaaagttgcttaaagcttaagccatggggttagactttttcctgccctgtggatttatggcctcacatgtggatgggagaaatgcaacagcaggtcaccactgggtgaaccagcaacctctgctgtgggctgcaactacttaccctctcaaggatgcaaatgaggttactcccttgtgtaatcatgttttcactccaacccattgcctccttggtgggcttagaggaattccttcactgatacagacaacctcaaagctgaccaggattgttttcagggattttacaagtaggggagaagagctcagaggtagggatttcagtttccattgttaattcaacatcctttcttcctggaagtggaatcaattacatattctctagcagaatcaactctttttttaaatagcaggtgataaggatctagggaccattctaagggatttctcttttccatgatcaaattctttagaaaccatgaattcttctgacagtctgttatttcacaaagggactttctaaaaattggcctacgttggtagcagatttgcactattgtcaaaaactacccccatgtgctgtgcttaactgtttgggtcctaatccaagctctaccactcctatctgtgacttcgggtaaattacttaacctccctaggcctcagaataacaatatctacctacatgcacctgaatctcttagaacaatgcagcagacagtgagtgcttaaactaaccttggccatgatgacaatggtggtggtggtggagatgatgtgctaggtgcttgactagtctctttagatataagcgaatcctcacaagtatccatttcccttttacagatgaaagagcaagtctcagagggaataatcagcccaaggccataaagttaataggtggcagggcaggcattcaagccctggtctttctaatccggcctggagctctttattgcaccaccaggttactggccccagacatcagcaatatgcattaggaaagttctttataatttagaatcatttcacaaacattacttgtcattgtttagcctttccttgaatctataggttttgattaccagcatcacaatgaacagatgagaacatgcgttcagataggatgaagctggcttgagtttacccacctaacaagtgtggacagggacctggctcagcctaggttactccgcctgtggaatgaatgctttctatagtccaccatggctttcagtgtccaatctgaattcctttccttgtccatcaagactgccatctgttccctcaatgcatgctttggtttttcattaaaactccgatcaggagtcccttctcagctggtcagctcaccaggtgttctacttggatcctctgcccttgctatgctgttttcaccatggtcttgacaagtttttcttcataactgaccttcaaggaagatcctgtgactgcctaggtcacggggctgagatttgacccagctggatgcagagaccctccaagcacttccctacactgctgtgttctcagaatcactgctcccttagccctgatgaaggaacctttagaaggcctgcttagtggctctgagctctctacaggagaaaagaccatttctgagataaccagtatttgactgaagtagcagtggttcttaacaagagctccttaaagttgtcttcaaagtaagccaataagcagacacagctgttggtgagaacaggtataatgcataagtgtctcagttctgaagaaaacaggtggtttacatgactagcttagaaaagagtggactgggttgtatttgaatgttgaaattacaaagtcaagagactataccctgtatcatagaagggcaatacatttttattgaggatagttatcaaatctttattgagtaccatctaaatgttgtaaactctgcactgggcaccatggatatagtagtgaataagacggacaaaatccctgtccttgtgaagctacatcctactagaagagctagactaaaaataaatgcataatattatatttgatagtaataaatactattctccagaaaaataaaatgtggtaaggagatagagattgagtgtgtgtcaggggtaggtatcatggtgactgtttttataggaaatggaagtatctctggggagatgattttaaaggtaagaaggagctggcaatgcagagatctgggggaaaacattctggattgcaggcgtagtaagaggaaatctcctgagcggaaaggaactgggtgtgttcattaaatagcaagaagtcattctatatgttaagttcccttaagaaagtagtgtaatttctctgactctcattttccttacctacataaaactcagatgtcaactgtggcctcttccgctctcaaattagggaaatattgcactaatgcatctccccaaccatcaccctcactacaatcctgtagccaataaaagtctggctgggcgaggtgactagcgcctgtaatcctagcactttgagaagcccaagcaggcagatcacttgaggtcaggggttcgagaccagcctggtgaatgtggtgaagccctgtctctactaaaaatacaaaaatcagctgggagtggtggtgcgcacctgtaatcccagctgctcgagaggctgaggaaggacaattgtttgaacccgggaggcaggtgaaggttgcagtgagctaagatcgcaccactgcactctagcctggtgacagggtgagactccgtctcaaaaaaaaaaaaaaaaaaaaaaggcccaaacccctgcctctcaaagatttcccagttcccgatcccatatatacagttttgtctcttgaggctttgactgcaatgggaaacccagacccttttataagaaccacagaaaccccctcctaggacttgtgtgcatagcagatgagctgaagatttggggctgaagagagacctgagaggaaaacagccaacctgtacaggaggtacagggctgacggctcccatacagcagtgctaggaattctttggctctttctcagggctagcctctaactttctggctccctctcctcttcttttatttctctcaccttttccttccaataacaaaacaacaactttttctcttttctcctgcccccatctcttttgacatcacaaaatctcaaccacccccaaaatatctttcaaagtattttcttgaacaaatacagtggcaaccctcaacataattctggagccagttttagtaaaaggtatttttcacatctttgcatttcaattgcaggcaattatattggcttttttgggttattggaaggatgacacaactctgtactgggcaccatggatacagtagtgaataagacggataaaatccctgtccttgtgaagcttcatcctactagaagagctagactaaaaataaatgcataatattatatttggtagtagtaaatactattctccagaaaaataaaatgtggtaaggagatagagacaggagatggacaagctttagtggcattactggcatacagtaaatatttgattaacagaggtgaggataagtgtggtgactgcagtggtagtggttcttatcaacccactacttgtttgaggccagacaattttgcagcttaacttagaggagctaaagatatgaagaactaagaaagttcttgccacaaagagggaaacagaatattgcaggtacactgaaaggcaaaatgaaacaaaacaaacacaaaattctggagactggaggtaggtcaaagagaatggagaagaaaagtgatagatgcaaagctatgaaacaaaaatttaaataagctttataagaattcagacctaagtctgaaacctggtgggtgaatggcacttacgatctttcctgcactgtggaatacaaatttgcagaatgcagttgaaagagcacaaaatgacttctggttaaggatcacggtgtataggcattaattcttaccctccccttcttgaaaaatctcaaactaaaaacagaaaaatattttagttgccaatgaaataaggatacgactgcaatcttaaaccacaaactatgtagcaaacctgccaaatgctgtgaaatctggaccaaaatgaggaagaacactaaaaactaacaacatatcctcagaccttgggcaagagggacatttccccaaaagaaagtgagattaccctgaaatgccatccagtgattcttcaagggaggtaagatccaggggtactggggccatggcagaagaggactcttcctttaggctcaacttgataccacagaacatggcaggcagaaaagcagaggaaccagagtggtacccgatttttatccaatattcattctccttgctgtgggaatgaccaaggcagagaaagtggaggaaaattgcattttccaaattaccaacctttccaatgacaaaaattgcggtgtgatatacagttccagaataaggaaaagagtagatttggtgagaggctataggaggcaatatactgtgttcaagtttactaacatccctca

SEQ ID NO: 7 - DNA, 5001 bp, Homo sapiens
actactccccttcctccatggatgatttttcagcaagtatacaagatgaatgacaatctgaaagaaccatcccacagacatgctttgaaatgagagagaaaataaagaagaaaggaatgtaggacaaagataaagaactacaaaagaaatcatctaagaaaacaaagagtttgggtagagttccccataatctcaaagaaattataggagataagtgtaaataaaaaatattacagaaaaaaaaagccatactacagccaggcgcagtggctcatgcctgtaatcccagcactttgggaggccaaggcgggtggatcacaagatctggagttcgagaccatcctgaccaacatggtgaaacgccgtctctactaaaaatacaaaaaatgagccgggcatggtggcgtgtgcctgtagtcccagctactcgagaggctgaggcaggtgaattgcttgaatccaggtggcggaggttacagtgagcccagatcgtgccactgcactccagcctggcgacagagcaagactccgtcaaaaaaaaaaaaaaaaaagccatactacaagcaaccgaaattagaataaacctaacttaaaacagacagtacttttaatcattcattcattcattcgttcattcattcatttaactaattagtgaataccccctccatggctggagtgcttctagatgctgggaacttagcagtgtccaagacaacatctctgccttcatggagcttacaacctagggtggatgggggatagtaaaaagtaaagaataaattttgatagtgctattaaaaaaagtaaaacagaacaacataatagagtatgaaaggtactgggtgaccatgaaagtctctctcactgcaggatattttatctgaaacctgtataacatcatgaaagattcaggcctgcaaatatctggagagacattctatatacatattatcataaaaaaaagattataaggaaaaagacatgaatgataggtaaggaatattcaacaaatatataattggtgtttgcaaagaagaaatgaacaaaagaaacagaaaatatgttcaagaaataggaaaaacaatcccagaacaaatgcttaaatctgcagtgagagaataatgctctaatgaaaacttacttgagtgaccaataccagtacataaaaataatatggataaccagccctgaatctaggctggtctcatggcttgctttgacccatagcatgtggtgaaaattatttcatggcagccctgagcttacagcccgaagaggccttgcatactttcactccctttctcacagccctgctaccattttgtgaacaagcctgggccatcctgctggagtatgagagatcgcagggccaagtcacccccactgtccctgccaagagataatcaactaccacatgagtgaggtgattctaggccagtcaagctccagttgacccatgtcctaactcattcacccaagatcagccaagccatatcagcaggaccacccctacagacctgcaggtctgcagcaatgattaatggtgtttgttttcagccacagtgttttgggggtgatttataagtcaacacaagctaagtatgatgaatgtctaaatgtttttcacaatctttttcttggctttagagagatgttagaaaataaagtcttctgtgaagaaaaatttacctgaaatccagcgtatccaattatattttagtttctttttcttctgttaaaggaaacttacatttaataccttttatttaaaatcacatttcatatgtctaatggctgcttttattataaaaatggattctatttcatcaaaattctacctttttattttctaaactgtatggatgtataaacagatgtgcaggacaatttttatccaatgttaatagctgctctttcattggcagcaagagtttgtataatttttctgttgctctttgtagttttctgtgtggcttgaatttattgtaatgggcatgtatcaactttgtaaaaacagttgagtcattcttttaaaagagctcgacagacagaaaggaagtgctcagaaaaggctgcgtgcatgttgaaaggatgtaagagcaacatgggatcctggattggctcctgtgtcagaaaatggacattagtggaaaaacttgcaaaatttgaataagatctttgattattagtattgggttaatgttaaagcagatttgatcattgtactgtggtgggtcatgaaagatgctcataatagaagttgagtgaagggtgagagggaactctctatactattttggcaactgagtctaaaattatttcaaaatatagttgaaaagaagggataagactgtacttaattgtataaataaaaagtcccactttgatctatcttacttttgaaatggaaaacctatcattctttgttaaagaaagggggaacagttaaaagatagccagtaactaatgcacatagtaaataaaaattgctattaagtataagctgacttcgattcatagttttagagtttcaggatattctgggaaagaaatttgctgatgtaaatgtataatgtcagcaatatactatcactgctgttattaatattttgataatgtttggtctgtcaaggaccaaagcaattctgtattctatacaagcagcttgtatacattttatacttctaaagtaattattaatatattttcagtttaatttaaagattgttatttactttgaccagaggaataatttaggaatcagaacagtagtttacatctccaagttagcaaaatgtgacagatacataatctgtattggaagtgatttaagcctggtatttgtgattcatcaaaggaaagcccatttggtctaggttgaaatagtttccttagatgaggagtactctcctttttatcagttatagtattcttcacatccattttggttccaggactaaatgacatccacgccacaccgtgtatcaaaacactctataacacatttttaaaaacctctaatacattctgattgttttataaaagagctatcttttaaaagagcagaccaagttcatgacagagaagttctctggtgcattctgaagcaaatagaaagaaaacaacaaaaatcttagaaaactcgtaactgacaaaatcaactgcatttgttttagtttggaaacagcaccagcaccagtttctttcttctaaaagagtaagaattcacagcaagaatattatttttgtttacaagaattgtgtctgaaccctctaaaatacgactgtcaagtcaaatgtcaagaatgttaattagtgaaaggaaggggaggagttgacgggaggcaggccgtcagcaccagctcactctgtaaacagagctgtgtcttgaattccacagcaatggcatggaggcattctttgaaaagaggagataatagatgatgaagtatctagcaaaaaagatatgaaaagcttctgtccaaacactgtttatcaaacaaatatactctgattgtaaactgcctaaaacttgagtttcagtttgtttagctcaccagcatgtgagtgtgtatattcactatttgagttttatttcagttcttctcattgaggtcattccttgtttgaattagctcatgccctctgttcagaggatctcttcaaagtagattacaagattcagagatattttttaagtccattgataagttctccaattctaaatattccactgtttaaccatcggcccattagcccaggcacaaaacagggaagaaagatacacccgcattaaaaaccaacaggttttttatttcctcaatgctcctgtgtcttaccctatttagaaatcatatggcatatgcaaatagatgtggataggtttgacaattaagttattattttatttttcttttagacctagagtttaaccaaaaccatcgcttccatgcaacatcgccccaaattcaacagagtgggacttggcagacaagttttaattatagaccttgcatctatcttgtgtccatcaatatcatggttaacttggaagttaaagaggcattttgcaacatcacaggtctcttctcaactcatttaaaattaatcccagttaaaataaaaaacacaaatcaaacagggcatttttcatattcattttgtaggtgcactgtcagaattataaatcagctttgcctaaggagtaaaatgaaacacacccaaatgtagtatttttaggaaaaaatgtctggaaatgagtgcatatgttactatgaatttttgttaaagataagcaaaactctaatatgctaaaatttattgactggacaaaaatctcctccacagatgcaattattcacatactcattggtcaaatatttagtgcatgccttgaggatacaccacaaatcaaccccttctctgctcctcttccccagtctccaaaatctacctcctacctccaaccccacactcacatggaattgcaaatagcttgattggataagcatggacatcagagaaaactctctgatacatttttgacacttgctaataaaagtatgttgggtgtttttctttctacctaaggatgttccacccatcatggagggaaaatggggctaagagaagcctgcctcagctggtggggtcatatccactcacagatgttaaggagtctccatgacaatgaggacttgaggtggggaagaagagacccagatatctgctttgccttctgttcaaaagccaagtgtctgatttttcaagtctagggctttaaaacaaaaatctcatttgcaacatgcagtcagcagcggggtgccaagctcaggacctaccccaaggggctagcagcactgtagcctctgagaccaccgtgccacctggctgtgcattcagatgtcatccctcccctcagcagggccaggctgaccaccagaccggctgtagaaccagttatttgtacaccatgtttgaaatggacctcagaaatgg

SEQ ID NO: 8 - DNA, 5001 bp, Homo sapiens
gtacatttggtgaaagtcagggtgttcatagaatttattatccaaactggacatttttgaaagagagaactattaataatcatgccaggtcaacaggcatgagtggagcatgccccacaaagacttggacacatggccatacctgtatttttctgtttagcaatttgcaattactgcacacttgaagcatgtgtagcttccctgaggctccacctctagggttatactgcctggaaatgtattttggggaaaaacaaacttgttgaagaaaatgtcctcacaaatgtgtagcaataactctaggggaagtcacattcccacttgtcttgcccattgtggttagaggagattctagaattagaaaagaaaccaaaaaatgaaagatctgctctaagggcttaattttgcccttcaggaaacaaacatacagagtggcccgtgggttctttaaaaatgttccccatcaatcttccacctcctgttccttcaactgcctctatcttatttcactttttgaaaaaagttgttttatctctggcctagaaactttggtacagtttgtcaatatcaggaagtccattaagtaagattgcatattatccttgccagagcacggctggctgtccagcagacatcattttatgtttttgtctttctttatttgaaatacctttgatgtatcatctcagacaaaaaatgtagttgttcaacagctcagggaagaaagcctgagcttgccacaggaggagacagggctaaggctggggagttggggggagtgtaaataaagtagaggactgggcagagctacaagaaatatttagcattcctggcttcccacaaagggtaggtcaaggagagggaatgagcagttgggatggagcgtacaccacaactattctttttcggtcctaatccagtccactgtgacacataaatgtccccagtgggcagaccccgagtttattgtgttgtgtggcaaatgctgagtaattacacacgatgcctgtctatatgcaggatggggtcaaactctgtggcaaagacacagctgctggtttcatggctgtgtgacaaatccacttttgctaacaatcgtcaaagccatattcataacactatgtgtttaagggattgagcactaaaagtccgcttccacaggcccctgtcaaaacaaagtccacttctttacagtgtgcccacaggctgtctgtgtcaaaaacctggtgtcactttttggagtgggatcttggaagaggagccatgctcactgttgtttgcctggatagtgaattgaagatggggctctcttttcttgaaactctcggcggggtggggggggaaagaaacgcgccttagcatccaaaataaagacaaccacacatacaccaaaacagaaacagccattttgtttttaaaagatctggtcattgacaggctttctttctgccccgccactatggtcttctcgggttaattcatctcctgctgctgcaggatctataaaatactgtattgagatgacttcagtaggtttccaacagtgggattttccagctactggaaatacccaaggccagtgtaaactcatttgtttttcttaatttgagccttaattgcagagcctactttttgctggatgctaatcctctcaagcacttctgaggcaaacactctaggagaggatgtggacagaagtacccacggaaaaggggacactgtgacaaaggggtcagcaggtgaacaaatgtcacatatacctcctctgtgtcatgcggatgagcaggttccaggtgatgaaagtgagaaggtgcctcccattgcagggccctagcaacataatgctgttcagaatgctcttaatacagaagtgcctatattagtcagtgttctccagagaaaaggaactactgggagagagagagattagaaggaattggctcacacaattatggaggctggcaaagcccaagatttgtagggtgagttgacaagctggagacccaggagagccaatggtgtagttacagtatgaaggcgggcaggcttgaggtacaggtacacttcaagtccaaaggcagcaaacaactaatttttccttctagttcaaaggtcatcaggcagaatagtttctatcatgtttagaggagggtcagcctttttgctctatttggaccttcatctgattggatggggtccacctacatatggtgggcaatctgctttcctcagtctactgattcaaatgttaaatatcatccaaaaatatcctcacataaacatccagtataatgtttgacaaaatatttgggcaccatgtgacccaggcaagtagacacataaaaaataatcatggcagcacctggccatgaaatgataaaaccgagcttcaaatctagctctgtctgactccaaaacccatatcctttctaccactgtagtgaccgattttgttctcaggaaacttaattgttcttaaggaggtaagatttataaacattaaaaactctgcttaagaaaggtatgtgaggccaggtgcggtggctcacatctgtaatcccagcactttgggaggccgagatgggcagatcacctgaggtcaggagtttgaaaccctcctggccaacatggagaaaccccatctctactaaaaatacaaaaacaagccgggcgtcgtggcagaggcctgtaatcccagctactcgggaggctaaggcaggagaatcacttgaacccgggaggtggaggttgcagtgagccaagatcatgccattgcactccagcctgggtgacaagagcgagacttcatctcaaaaaaaaaaaaaaaaaaaaaggtatgtgacataatgtgttacattatgataaatgatcaatcatattaatcagataattgacccatcagctgtaaagtgtgaaccatgtttacacccaagttttattcccagtggtgtaaatgtccttttttcactatttcttgagtaggataccaagtgtaacacacactggagtgtctttcaactccacaaggaagctggaactcagaggggtctggaccttccaggcaagtccctggctctgctcaggaagtctagccatctgctgatgccatgtgatatggtttggctgtgtccccacccaaatatcatcttgaattgacctggtagcaagtaattgaatcatgggggcgggcttttcccatgctattctcgtgaaagtgaataagtctcatgagatctgatggttttataaggggcagttccctccacatgctctgttgcctgctgtcttgtaagatgtgcctttgctcctccttcaccttccaccatgattgtgaggcctccccagccacgtggaactgtaagtctgttaaacctctttcctttataaattacctagtctcaggtatgtctttattagcagcatgagaaaggactcatcatgctacatggtgacagcagtgatggagacagtgcccaggattgcctccccatgacagctagcaagggctgtgatgctttacaattactgtcagcccagaattaacttccattccgtagacattcatgggtgcctgctataatacataaaaagcacaatatggaaacaggctggggccaaagggagacaaagacccagtctctgccttccgagtgcttgcaatagaaggggataagaaacacagctgtgtaagagagatgccagatgatagatacatgcagtatactctggcagttcccaaggggagagatatcactgcaccctatggggagctgagcagaggagacatttgacgtaggcttgggagtatgtgtaggagtccagcagatggggtagggaaggaaaaacaggagcaaatgcacaaaagaggagaagcagaggatttttctaaacagcaatgactcatgcagtttgtctgaattgtagaatatacgagagggagtagcaggaatgagacctattttctgggcttgcacttcaccctaaactccagtcatctgtaagattcatctcttttggctcatcctcctgagcaggagcagacaaccccaggcaacaggcagcacttgcccagcagtcaggctgctgaactgctctccagtgtgtgtgcatgtgaggacccatgaaacaggggccacagtgtcctccccacccaggaactcagcctggtttatgagaacaaacctcgttggcctgggcagctggtctgatccacttcctgaactcctgctctctctgtcctaccccaccacccaggccagcctctctgtcctgaagctgagaccttctgaacagaaggctgggtcagctctgcttgcagccagaggacactgagaaggccaccacttacaggggcccttctcctctcaggtccccagtgctcctagggtgggcagccagcactgctttccatctgattccaagcaatggctaaggctggtggctacctatccattaagctgtaagatgtttgcccttgggatgtggtttaagtgtcagtctgaggtttaaaataaaacaaaacaaattctgtttcactgcatctttaattgtcgacttctggggaagtatcttctaaagatgtgctaggcacaatcacccgtgggccaaactccatgaacagaagtgggcatgttagaatcctgcgtcagctcttccctcatctcactgcctgggaaagtgtctggttataaccccagccccaacttctcagctctgacgcctgctgttcatcaaaactgactggagggttgctagaaatgcagaggctggggtccaccccagacctgatgaatcctaatcctcaggctgagaacataggcctatgggcttttattttttatatatctccccaggtgattattatacacagccagggtagaaaacccctgccttaggcaaatgccttatagatttttttttgcattcatattctctattcattgcctcctagaatttcaagcattaggaaagatcttggagatcaactagtctagcactttc

SEQ ID NO: 9 - DNA, 5001 bp, Homo sapiens
ctaaactcatggtagtgagaaccagcgtaggagctggggatatagtgggcagtccttcccaggcttatgtgactcagaacgatctgcacttagagtagagattggcatcccactgctggagggacacaggtgggaagtactggcctagctcacccctgtatgatgatacagactctggaccttctgcttcattcccctctgcctgtactgcttctgcctgaccctacacccccagcttggggtggagatgacacctgcaaacacatgagacactggtgggaaaaccatgttctagaagtgtgtgaaatgatgcaggcagtggcccaggtgacttggcttttttctcagtattgctttgagaccatgccatcataaagtatcttagaatcactgaagaaaggaggcctttttttcaaggatttttttaagaaataagaaattctagatcttgggacttggaaatcaagaatcctcgacttccaccccagcttgaacacaggttctttgttgcattctgagggagcttagaataggaatcaacctccaaccccaggggctgtcaaggctgagttcctagcaacgcttagccaggggtagatgctggtagcaggagggaggatgggcagccggcacgtgggagacaagagtggggagcaagaggaggctgggaggggtgtggacagaatgagactgccttggcccctccctgcccagagttcaggctgcacgtggtccacctggcacctgacactccatatggcatcaattaaatggactcttcagctaatgatctaaggactatacagttatctgctttacactctcaggaaatctagcctggtgccttgttcagacagattgttcattattgcatgaataatgacggactaaaaatgacacagcagggaactttatcttcagaggaaaactgctctcacccactttcctaaggaaatctgcctcggttctaggaggaagagctctctggcgagttggggctgacccccatttctcatcagctcatcagagatacagagctggtccaggagtcctcccccgggctccccaccacacacacacttaatccatttattttcagatccctgcccagaaatctccaggaaccctgaccaggccttgcatccctaagtccaaaaattttgcagcaaaaaaagccattctaacttgaagcttttaatagcaaataaataaagtgatccaggctccaaatggtccaggcaaggccaccccacataggactgtgaatatcacaataggtgattgttttaaagtgttttaatgagtctcaaaacatcctacataatatcagcctccacttcagtcttcttgacaggctccagtaaataacatgagttgacaggaataaaacagcttgctcaggagtaattgagtggaattagaatgaacagacaagaaagaaaaattggcgcttgggtcacaaggaactttttgttagaaacgctctgggggatttggtgggatgtggtcccgctgactaatcaccagtatagaaagtttacaatctctccaccatgccaacgtctttaataacttgaaaagcacaagaggtggctgttaatttcaaagacagttatatgaagcttttattgagtgtggtgcagagtatatagttagcagcctgcaagataatgaaccctttaaataaggctttcaaaaaaacagttttatttttgcttgagccaaaagaacagtgattttcttctggttattttaaggcagaaaaatgtatgtgaagtacaatctctccattgcacacacaaccagccacttttgtcatcaagggcatctgtccttgatgccacagaaccgtgactattcagatagaataagggttgatattgtcatgacactcctttcccagggaaagagcagatgggcaaggaaggagttaaatgtggtggcaccaccctcattttcttgtggacactggggcttctctcctcacccctggctgatgatgccgtgaagaggtagagccccctcatgcatgtaatgtcatgatgtggtgaaaccagagatgaaaccagtgggttcttgagatacagagaaagagaaacaaccaggacaagggcaggacttcacatgattctgcagggggtattctgtgggccagagaccatgtgtgaggagcaaagtgggtacagatgggctttctgctctggagccttctgatcatggcctgttcctacctcttcatacggcattccaggaacagatgaaatgggctgttgatggacctggaacctctgagctatggtgacagggatgggtcctccctcttgcccccaggcagtcacctatgattctgacctgtgaaataccttatgcatctatcattctccctatcctcctccacctccttccttctcccctagtgtgtatatatgtatacgtgtgtggagagattaagagagatttgtcttgcccaccttcaaagccatcaattgtttactcattctgtcattattgtgttgggtgttggttaagcactgtgctgaaagctgaggatacaaatgtgagaaagtctgacgtgaccccctctgaccctcaagcatctgggccagccccacctgggccccaccagcagcaggcaggtgccaccccagcggggaagctgccttcacccctcatccctgtgagtcacaacagtggcttcagctgtggcacccccccccccacccgccgccaggctgaggctcaatgggacctaatcctactggccaaggagtcaaaacaaaataacaacaacaacaacaaaaacaggtcttttctgagccagtcctgtgaggaaagagaacaatgtaaacagagagattcgttaaagaaaaatgatttatttcctgcctcagtcctggcaacaaacattgtctttctcattacctaattcagtcttgttggcagcatgtgttctggcttcactctgatttttttttttaagacacctctctgcccttcatgtaatatggggagtttagcggtttctcgggattggccctgcaagatacatcaagttttacctctttctaggtgtcagtgcttgatagcccaggaaaatcccttctagaagttttcaggatctggtaagccctgggcagaaactcacagcctcacttgtctctggcagtcaggaacgtgctgggagctgcatcgtctgtgggagtctggaatgcctaggaaggcgagttgcagcctacactgagttggagacagtctcagattcttgctggtctcagatatacagagatcccagaggatctccctgttttaaggaaagagagagctacttctgcagttatcaggaagcaaaattatctctgagtcaaattccccttccaaaggtcttagccaaaaaaaaggaaatttttaatgcacttttgaagttgttatactctttaatgtttagtgattcccggtcctggcagggtcttgaaagctcctggaggatgtatttgaatgcagattgctgcttcctacttccgaccctccaccccagagaatgtcttgagtggggcccaggaatctaaatgtttgacaacttctcagtgattcttctgttttcatccagtgccactcaaaaggaataatggtgatgctgtccctctggggctacctatggggcaggaacatcaaagaggcccaagactggacggaatgcccttcttatctttctaagaaatggtgatctgggggctttggtacagcaggggagaaggaatgctgggtctgggaagctctcaagtcagggccaaacacccctttcttaagcatgccagcttgctgactcacatcttcgggagcttggtcagtgggctcccagcagtccctggagatgtggtcagtaggagtgtaggaaatgccagtgtgtgacaaatactatcgctggagaatgactggtgagctttttgggaggtgccctgggggtccaggctgagcagctggcaggggcaggaggtgagtgtcagcctctgaagtcagcctgaggttccataaagccacatccttttgctctcacttcagacccatctcacctgtcaccatagcccttgccaggtgtgcaggtgcttgctgcccaaggcacctttagctaccctgtgctcacacgagcctgtatagagacatccttttgggttggaatgaatccctccctcagagaggctgggggcatttctgactatttcagagcttctagaatataatctcccctgcaagcatttgactatggatcctctgggcagaagagacttgcttctccatgcaggacctacttgtctacaaggaaagaaatagctcctgatctagtgcccagagtttgttatttttaacagcaaaaatatagagaagttactattcagagcttctcttctggccaacacaggctatggatgagtggaatggaaaggctgccatgtgtacatcaccacctgcgtggattcaagtcatggttcagatctgcctcggcctccaggaaaatggctctacacagccagtacacgggcagctagagacatgctgggtcactccatcaacaactatttactgagctcctgtcattaccaggcacacttctggactttttgttttgtgaattaacctttaaaaaagccagagacataggggctatattgcagccctatgactgactgtgaccacatccaaacccccctctcacctctggcatttatcagactctgtacggtgaatctggccgtagcattttctgcagaattcagaagatgtctggtttcatacaactcctctccaccccttcatttccatgaagttccatctttaaggtagactgaccgggatgatctgtccggaggctgcgacatcactagccttatcttttaatgttgttaattctagcagatgaggtatgggtatgtggaagccgcttttcttctgaacctaagcaacagctgtaggaaccatttagccaggaggatcatcaaaccacag

SEQ ID NO: 10 - DNA, 5001 bp, Homo sapiens
ttttataaattgcttttttcacttgataaataaaattcatattttatcatattatcagattttccaggatagaccttatgaatttatagacacagaaaatgtttcttgaattactgactgattgagtagtaaatataacattttctgaagatttctttttgttgttttttttttttttaaataggaaaagcactaccagcaactggacaaaaagcaaatggtattggtattataaaaagtgctccatgagagcaatcaaataatgataatgctattttttgtgtacaaaaaaaaggtggtgaggtagtgaatatagctgaataattttctatgctttaataaaatttttgaaaataaatataactaatttaaatataatttaaaataaatttgaaattaaattaattgttaaattacattaaattataagcctaattttaattaaattatacacctaattttaattaaattatacatataatttattaatttttaatagtaaatataatttaatttaaacattttttcttaaaactttgatgaacatttaaacttgtagatcaaaatataatattcattgttgagaaatggacattagatttacaaaaaaatgtgaggcgggatggtgtaaattaagaaagtagctggctaggtaatttggaggtttctgatgaggaaacttgagggaactcactttatgtagactcagtatattcccactcaaaaagaagattaaattattgctgctttggagcttactggaagcagagggtagaagaacagcaggaaaccacaggaactcatttcttctctctataggggttacacatcaatcatatgtgcttcattcatgtttgttagttaactgggatgcacttggatatcaaaacattggcggttttctttaaaaaaatgctgtttttgatgaaatagccattgtataaaggtacctcagaggctgctatgctataccatatcaaactgactttagaaaaaacaaacgagaaatttatttcttgaatactaaaagtgtaactgtcaataatcatggcaaagattttgatatgtaaaagttgattaagctgggctcagtggctcacagctgtaatcccagcactttgggaggctgaggcgggaggatcatgaggtcaggagatggagaccatcctggctaacatggtgaaaccccatctctactaaaaatacaaaaaattagccaggcgtggtggcatgtgtctgtagtcccagctactagggagcctgaggtaggagaatcacttgaacccgggcggtggaggttgctgtgagccgagattgtgccactgcactccagcctaggcaacacagcaagactccatgtcaaaaaaaaaagttgattattatgaaaaaaagtcaatggtgattcagagatttttgtttacattttgtaaatgaaaatctgaatactcattagttattcgatgtgtaatgcatacttttttgcataagtgaatgaaaagatggcaagagaactaaagttgagaatccagaagttgaaaatatcagaagtcttcatgactgtggataacatgagtatttttagaaacgatttttctccaagtagatatctaaagtaatgattgagagcactttctgccagcagaagcgaatgatacattttcttttcttttcttttctttttttttttgagacggagtctcgctctgtcacccaggcttgagtgcagtggcgccatctcggctcactgcgaactccgcctaccgggttcacgccattctcctgcctcagcctcccgagtagctgggactacaggcgcctgccaccacgcctggataattttttgcatttttagtagagacggggtttcaccgtgttagccaggatggtctcgatctcctgacttcgtgatctgcccgcctcggcctcccgaagtgctgggattacaggcgtgagccaccacgcccggccgtgaatgatacattttcatgcactctcattgcaacttcatagtttctaacatttattcttctggggtccgatttggttctctcatttgacatcactttttttggcttcatccagcagattcacattggtagaaatacttttctatgctacttgtagtcatgtgaaacctaatctcacccttgcaatctgaactgcatgttttatagaatctatattgtgatttttcatgtgtatattcctgtcatgtttgtgtgctaaccaaaacaagagcaaagcaacccaaagcctaatgggtaacaatttcaagggcaagcacgaagatttcagctggatacaaacactgcatgattgatggtaggctgtgtcatatttacctgtagtcaattatgtgttccttttgctttgtagtgtctcctgagcaaccgcctttattcacagtaaacatattttctttaattattaacaaaatgttctgtgatatatacatgatatgttaatcattatgttgtcaaacccattcagcatccggtgaaagacagagatcacatttcaactagattcttaggaagtatggattcactaacttcagcgaaggtaaatttgccactacaaatttcattctagaaaatgtagatgaaaatattgaaaatgctcatgttttttgattcccactttttttccaaatgagatggaaggatttgatgtaaatatgctgatgttcttgttaatatctttgtttataaaatgatatttaaggcataagacagacattttacaccttaagctctagcccaaatgcttttcctttaaagttgtcatcatctaaagatcccagttttgaattcctgtgcatgttagggatttgaggaggtgtattttgacactaaatattttcagtgcttcaaaattgattgcaatattcttctctcttcttcatctagagaaaagctatacctgctgacgttacaattgttttagaacttcaactcctttatgtcagtgttgttacattgagaatctttacttaatcacatcttctgattaccagattgagtttctgcatgtgtgtgtgtatctctgattaaaaatgaataaaatgattaatcattcttttgtaactctttggtagatacagtgttttaaaacaatgattctgagctgttttggccttagaatattttcttctactacaatttattgcctacaggtaaccaacagcctgaattaacgttttttcttttaaatcactgcaatgcacattaaaaatactttacaagatacttgcactttcataggtaatgtgtagaatctgtttccaagtatcaagtcttctatacgatttcacacagcgtacataatagctgcaactcggcttttctaatcagtggtatatatttcagatctattcaggttgacacaatttggtcatctttgatttgttgtgtggtcttgtggtatgccattttatgactgcaccacaattaattaaagtctcttcatgctgatacaaaatgaacataaatacgatgacataccaacatagatttgcttatgtggttgcgtttattgatttgtactatataagaaattaaatagaagtatttcagataccctgaatatagctatgtacactgccatagctgtattgactatattcattactccttagagccatgtttttccatcatgttatgactctgaaaaaccccagagtatgcttttcagagaatgacattggaaagaagaaatggccaaagtatcatttggtaccttggcttccttacatagatgttgaactccaggaatgatcaaatcacagttttagaacccctttgttgggccctataaagggtttccgaatgtcaaatgataaatagtctccagatgaagaaatcctctgtaacgcctcactgctgtgttttcttgcattttgtccttttctgaaaactttaaatacacgatttttgggtagaaatgaaaatctttctgttttatatatttgtttctgtctcatggcactctgatctctttgaatctggtaaggatctagccttgtcttatttataccagcaagcagtgttgtcacttaatgctctcatttttcacgtaaatgactgacattttcccaagtcttcacaagtgatttctgaagatgttgctgcattgagcagagactatgtcattgtaattgcagaagtttttaaattaaatatgtttaataaaattttagagcctgtttctctggaacacataacacataattgtgtaatgtgtatttaaccataaattagcttcataaaaagtttgtgtacataaaagtgtttatatccaaagaaattcttatttactgctcagtaacctctcatgtagaagaaaatacgtaacatagtttgctgagtctttgataataacccctagtgtaaaataaagccataaagataaaatgagagttgatattcaatgaaactgatgtgagtgaatagaaactatgaaacagtgtgtctatgggagagaggaggacatggggctgctattgtgaagaaggaatttgtacaagttagtccattttctgtaacttttatattctaataaaggaaaaccatatcttcatatttataaaaacaagattttactggtttaatcacaggggtggtgagaataatgaagaacaaaatgtggaaggcaaagaatgaagaccggatagtgagattagatttatcaacaaaaaagagtgcaagtggggtgggatggtgtaaataaagatagcagctggctaggtgtttgggggtttctgatgaggaaacctgagaaaactcactttatgtggacctggtatattcgcactcgaacagaatattggattattgttgcttcagagcttactggaagcagaaggtggaagaatgagagtcaaccacagggactcaattcttctctctgtaggggtcacacatcgacaataggacaggtgcttcatgttagcaaaatgcgatgcactgcatgtcaaactgactgtggaagcaaaacaatcaa

SEQ ID NO: 11 - DNA, 5001 bp, Homo sapiens
agaaatatatttcttaagtattatttatttatttatttttaaattttattattattgtactttaagttttagggtacatgtgcacaacgtgcaggtttgttaaaatgtaactcaataatcatggcaaatatttttatatataaaaggtgattaacatgaagcctctgatgtttcaaatattttggttagatttgttttatgggaatctaattacacattaggtatttggagtgtaatgtatacattttttgcataagtgaatgaagagatggcaggagggctaaagttgagaatccaggaaatggaaaaacaccagaagcctgcatgactggacaacatgagtatttttgttaactatgcttctgtatgtagatatctgaactaatgaactgagaatacatccttcaagcagaagtgaatgatacattttaatgaaattgatagtttttaagttagaggacaaaatgaagaacaggagaactattgtagtattatagtataaatggttcttgggtgatttcttcagggtacaccatagcgttctaccatgggctttgacatatatccttctggggtcctatttggtcctttcgtctgacatcacattttttggcttcagttaagaggatcacattggtagaagtacttttctgtgttagttgtagtcatgtgaaacctaatctctctcttgaaatctggactacatgttttatgaaacctatattgtgatttccatgtgtatgttcctgccatgtctgtatgctaaccaaaacaagagcaaaagcaacccagagcctaataggtaacggtttcaagaccaagcatgaagatttcagctggatacaaacactacatagtggatggtgggctgtgtcatatttacgtgtacttaattatgtgtcccttttgctttgtagaatcttctgagcaacctcctttatccacagtaaacaaatatattttcatctttgtgatatatacatgatatattaatcattatgttgtaaaacccattcagcttaccctgaaagaagcagatcccagttcaaaagtagccataagaaggaaggattcaccacctccaggaaaaggtaaatttgccaatacaaatttcatctggaaagaaggacatgaatatattggaaatgttcataatcttctgattcttacttcttttccccccataaggtagaaggatttgatctaaatgatgctgatgctgttgttagtgtctgtgcttataaaatgatatttagaagaataaggaaaagaaattttaaaaatgtgagctctagctcagatgcttttccttttaggttgtgataaagatcccaatgtggaatttgtatgcatgttaggggttcaaggaggtgaattttgaaactataaatatttttcagtgcttcaatttctcgttgcaatactgtcctttacctagaggaaagctatacctgctgacattacaattgtgttagaactttaacttctttatgtcagtgttgtcacactgagaacctttgaatcttcacccaatcacatgctctgattaccagcttgaatttctgcatgtgtatgtgcgtgtgtgctttcgtttgtgagtttgggtgtgtgtgatacctctgattctggaaaatgaataaagtcattaatcattttttggtgactctttggtagatacattgttttaaagcaatgattctgagctgttttaactttagaatcttttatactactacaattcattgcctacaggtaaccaacaacctgaattaatgttggtttgtttgttttgtattataccttaagttctgggatatatgtgaagaacatgcaggttttttacataggcacacatatgccatggtggtttactgtacccatcaacccatcagctacattaggtatttctactaatgctatccctcccctaggaccccacccccctgacaggccccggtgtgtgttgttcccctccctgtgtccctatgttctcattgttcaacttccacttatgagtgagaaaatgtggtggttggttttcttttcctgtgttagtttgctgagaatgatggtttcaggcttcatccatgtctttgcaaaggacgtgaactcattcttttttatggctgcatagtattccatgatgtgtatatgccacattttctttatccagtctatctctgatgggcatttgagttggttccaagtctttgctattgtgaatagtgctgcagtagacatgcatgtgcatgtgtctttatagtagaatgatttttagtctttggggtatgtactcagtagtgggattgctgggtcaaatggtatttctggttctagatccttgaagaatcaccacactgtcttctacaatggttgaaataattgacactcccaccaacaatataaaagtgttcctatttctccacatcctctccagcatctgttgtttcctgactttttaacgatcaccattctaactggcgtgagatggtatctcattgtggttttgatttgcatttctctaatgatcagtgatgatgagcctttttttcatatgtttactggctgaataaatgtcttcttttgagcatatccttcacccactttttgatgaggttgtttgttcttttcttgtaagtttgtttaagtcccttttagattctggatattagccttttgtcagatggagagattgcaaacattttctcctgttctgtaggttgcctgttcactctgatcgtagtattggaagttctggccaaggcaatcagacaagaggaaaaaataaagggtattcaaataggaagaaaggaagtcaaattgtctctgcagatgacatgattgtatatttaggaaaccaaatcgtctcagccccaaatctccttcagctgataagcaacatcagcaaagtctcaggatacaaaatcagtgtgcaaaaatcacaagcattcctatacaccaataaaagacaaacagccaaatcatgagtgaatgcccattcacaattgctgcaaagagaataaaatacctaggaatacgactcacaaaggatgggaaagacctcttcaaggagaacgacaaaccactgctcaaggatataagagaggacacaaacaaatggaaaaacattccatgctcatggacaggaagaatcaatatcacgaaaatggccatactgcccaaagtaatttataggttcagtgctatagactaccattgactttcttcacagaattagaaagaactactggaaatttcatatgcaaccaaaaaagagcccatatagccaagacaatcctaagcaaaaagaacagagctggaggcatcacgctacctgacttcaaactatactacaaggctatagtaatgaaaacagcatggtacgggtaccaaaacagggatatagaccaatggaacagaacagaggcctcagaagtaacaccatacatctacaaccatatgatctttgacaaacctgacaaaaaacaatcaatggggataagattacctatttactaaatggtgttgggaaaactggctagccttatgcgggaaactgaaactggaccctttccttacaccttatacaaaaattaactcaagataaattaaagacttaaacgtttaagtaagacctaaaaccataataaccctagaagaaaacctaggcaataccattcaggacattggcatgggcaaagacttcaagactaaaacaccaaaagcaatggcaacaaaagccagaattgacaaatgggatctaattaaactaaggaacttgtgcagttttatttgggagtgtgcatgaggtacctctgagttttaaaaatgaagaaagtaagtggtcatgctttcctgactctttggtagacacagccttttaagacggtgattctgagctgttatggttttgggttttctataatactaaagcttactgccgacatgtaaccaaaagcttgaattaatgaaaaaaaaattacccaaatgcacgttaaaaacctcttacaacatatgtgcacattcatagataacatgtagaactttattttgtgttaaaaagcttgtagaaaagttcaggcagtgcacttaatgaataaaacttggtctttgtaaaatcagtgatatatatttcagatctatccacattgacccagtgaggtatttcttgatttattgtataatctcatgatatgccatatgatgattacagcatattatgctgtcttcatgctgataccatatggacttaaatatgatgacataccaacatggatatgcttacgtggttgcttttattgatttgtactatattagaaatgaaacagaagtattggaaatcctagcaaacatagctgtatctctcccatggctgtgttgattgcaactgtttcccccttaaagcatgtctttttgacatgttctgactctgagaaaatccattatgtgcttttcagagaataacggtaaggagaggaaatggccaatggtctcggctccccttcatgaatgttaaactctaaactactcagatcacaatttagaacccctttgttgatccctatagagtgttcccggatgtgaaatgacaaataggcctttgatgaagaaacaccctgtaaagccatattgctctggtttttgtgtgtgaatgtgtgtgtgtgtgtgtgtgtgtgtgtatttttttctcttctgaaaactgtaaatggaggaattttcattacaaatgaaaatgtttctgttccatatttatttcctgtctaatgtactttgctcttcttggatatagtaaggatctcagcttgtcttatttatacctgcaaaaaattatgtcaatgcgtcatttttcatgtcaattactgacatattttcaagtcttcacaagttatttctgaagattttggtgcatcaaggagagactttcattgtagttaaagaagtttttaaataggttatattcaataaaatttcagagcttgtttctctggaaagcatagacat

SEQ ID NO: 12 - DNA, 5001 bp, Homo sapiens
tagtggtgttatgggtagttaaacataaaatagctccacaaagtgttgtgtatataaaagtgttcatatcctggaaaattctaatttactgctcagtactgtctcctggagaggaaaataggtaagataggctgctaagcctatgataataactcataatataaggtgaaagcatagagacaaaatgagagatgatagatactcaaactgatgtgagtgaagaacagctgtgaaacagtgtctatgggagagaggagaccatggggctgcttttgtgaagaaggaatttgtacacgttagtcaagtgtctgacacatttaacattttaataaagcaaaaccttatcttcacatgtttcagaatgggattgtacagatgtcacaatacggtggtgcagaaaataatgaagaaatgaatgtggaggtcaaagaatcaagtccaccaatatggatattagatttatgaacgaaaaagagtgtattgcaaattgggcggatgtaaacagagaaagcagctagctaggtaatttggaggtttctgatgaggagacttgtgggaagtcacttaatggaaagcagaagttagaaggatgagggtgacccacagggtctcatttctcctccctagaagttttgcacatcagtgatacatgcttcgttcacatcggttatcatattgggatacagcttaatctagaaaaagtgtttttttttttttgaaagctgtgtttgctgaggtagttatttcgtaaaagaacctgagagacccctatggtatatcatatgaaactagatttagaaaaaaggaatcaaagaatgcatttttagagtactaaacagataactgccaataatcatgacaatcatgacatatatatatatatatatatatatatatatatatatatatatatatatgtgtgtatgtcatattggttggttatttataaggaaagaagtctctagtgatttagaaactttgtttagtttattttcataggaatctgattacacattatttcattgatgtgtatgtttttgcaaaagtggatgaagagacagtgagaaggccaaactgctgaatccaggaagtgtaaaaacatcaggagtcttcatgagtataaagaaaatgattttttaaattatgactctaagattaagtgaactcacttcagatgcatttagaatatttgcgtaaaggatgatttgatttttggctgctccaggaattactggaagcaggaaagagtgatagaattgggataaagcacagtgactcattactcctctttgttactattgggcaccagaggtatatgttttgttgatattagttattcaaatgagataaacctgaatatgcatacattggctctgtttttcaaggagctaactattggataaaatagcagtttaataaaaattctctagagaataacatgatacttcaaccagactattttagaagtgaaaataatgttgaattctttacttgactcccaaatggttattttcaatgaatattggagtgatttccagatgtaaaagcttattcgtatctaatgcttgtagcaactttattttgtataagtatgtcaaatttggtaatttattatactttttgatgaagtttatatattctaccttgttgccatgagtggatgaagaaactttcggaaggctaaactagaagatacaagagatgtaggcacattattacaccatatgggtgtgagaaataatgaatattacatactagaattcaccaaacatatatccaagctgattaagttaggacacttccactgaagagatgtgaagtgtacattcaactaaagtgtcattatatttgtgtaccttctcactgatcgatcaagttaaagagcatgatgaatgtttgcagtaaaatgttccaaatcattctgatatcttgtgtgaaagacatgcaggtgcatgtatcacctgctttgatgattcccaggtgtatgagttggactctgattttagacatatggagcaagtcatatcacatttgatattgtcagtgtgtatttcttgaagcctgtattcctattttcttcagtgtatttccttcatgtttagtcccaagaaacaaagtgtaaaatatcaaagcctacagaaatacaggcaggaggatataacttgatgctagcatgctatctatgcattaatgtatggataacattatcatgtgtacatatgattgattatgtatcccttttgcttttcagtgtcttctcagaaacaaccagctgagaaggtaattaaagtctcatatgttgaactattaactgtatagtctatgaaacctacttcatgtattgattattttgtttcaaatcccattcaggctgcaagtgacgagaaagattctgtttcgaatatagccacagaaataaaggagggaccaatatctgggacaggtaattttgcaaaacacatctaatgtcatgttcaatcaagatagaagagaacttcccttccccaaataaatcagtggggagttcatctaagcttcacgttctgattgagcacgcctgagattcttcatttgtagtgagttctcaggtgaccctgatgctgctggtccttggccgttatctgagtagtaagattatagacttccctacattgaaattgggaagaagaaccattggagagcaggtcaacacataccaggctcagggagcagcataattttgctttaattttacagcatgtttccatcaagaggggaaagagaacgagatgaagtaatagatattataggcatcatatcgtattgttttaaacagagggaaaagtgatcctaacaactccataaacactgtagaatgagagctaagaggaccactgatgtagcacttattctcctcaaggaagagggattgtgaggcaggaaggaggaaaaagaagaaggtatttatgtaattttggggtttctgctgaggaaacctgagtgaactcatttcagatgcatttggaatatttgcataaaagaagatttgattctggctgctccaagaactactggaagcaggaaacaatgctagaattgggataaaccacagtgactcattactcctctttgttaccattaggcatcagagatacatgttttgttgactttagttataaaaatgagataaacttgaatatgaatacattggcttccttgttcaaggagctaactctcagataaaatagctatttaatgaaacttctttagagaataacatgatactcccaacaagactattttagaaacaaaaatgatgttgaaatctaattaactcctaaagtggtcattttcaatgaatattggagtgatttctgaacgtaaaacttattaatatctaatgcttgtagcagttttactttgtagaagtttgttaacattggtaattgatgatatttttattgaggctaatatattatcgtttgttgccatgagtggatgaagaaactttcagaaggctaaactagtggatacaagaaacttgggcaaattattacaccacatgggtgtgagaaataatgaatattatctactagatttcaggaaacatatatccaaggcgatcaatttaggacacttccactgaagagacatgaagcgtacatttaactgaattgtcattgtaattgtgtaccttctagttattgggcaagttaaagggcatgatgaatgtttgtagtataatggtgtaaatccttctgatttcttgcaagaaagacatgcgggatcatgtaccacctgctttgacattgattctcaggtgtgtgagttactcctctgatttgtcctcatcactcagcatatccacattgatattgacacggttttattttagttttagatgtatcacaaatcataccacgtttgaaattgtagtggtatattttgtgaagcctgtattccttttttttcagtgtatttctgtcgtgttccagtctccagacaaaaggtagaaaacatcaaagcctacactagtacaggcaggaaaatacaacttgatgctaacactgcatgaatgtttgaataaatttatcatatgtacatatgagtgattatgtatcccttttgcttttcagtgtcttctcagaaacaaccagctgagaaggtaattaaagtctcatttatacgttgaactagtaactgtatagtctatgaaacctactttatttattgattattttgtttcaaatcccattcaggctgcaagtgacgagaaagattctgtttcaaatatagccacagaaataaaggatggacaacaatctgggagacataattttgcaaagcagatttaatgtcatgttcagccaagatagacaagaacttctcttccccgaataaatcagcgggggactctttgaagctgcacattctgattcagcaggcctgagattctacatttgtagtaagttctcaggtgacactgatgctgctggtcttcgacatgaactttgcagtaagattatagacttccatacattgaaattgggaagaagaaaggttggagagccattaaagacataaggagtcaggggacagcataattttgctttaattctacagcatgttttcaccaagggtggaaggagaaagagatgaagtatagattttacagacgtcacatcgtattgctaaaaacagatggagaaatgattgtaaaaacccataaacgctgtagaacgagaactaaggagaccattgatgtagcaatgactttcctcaaggaagaggattgtcaggcaggaaggagggaaaataagaagttatttatgtaattttgggatttcttctaaggaaacctgagttcagttgcatattcgaacattttcctaaaagaaggtttgattttggctgctttaggaaccagtggaagcaggaaggagtactagaactgggacaagccacagtgactcattactcctctttgttactgttgggcatcagagatatacattttgttta

SEQ ID NO: 13 - DNA, 5001 bp, Homo sapiens
agtggaaagaaccaaaatgtccatcacctttgggtgggaaagaacccaaaggtccatcacctggtgaatggatacataaaatgtttgatgtatccatacaatggaatatcactcagcaataagaagaaactgagtactgatactgtattaggaggagacagcaaaatgcctaggcagatatggaagggtccccagagaatccccaaccagccccacaagtgtttacaccagatgttatgtgcagataagggaacctggacttgtcttgcctggacatgccagcagcagacccgaggcccacaagcactggggggatggggtggagtcaccaggaattcacgccttatgcagaggaggaacctggccgcttcagctcctgtgctcctgctattcaattgtgaggtggaaacctgtttgcaggacccccctctttgctgagagctttcctttcacttaataaattctgtcctcctcacccttcaatgtgtctgtgtgattaatttttcctggtcataagagaagaacccagattgagctgaactaaggagcaaaaaccctgcatcaatacctgctacagcacagatgcagcatggaaaattatgctaagtgaaataagccagtcacagtagaccacttgcttttcatttcagaggcttataggcaaatctatacaaagaaggtgggtggttacctagggctgagggaggaagggaaaactagtgaagatagctaaatgatgtggggtttgtttttagggtgatgaaaatgttctacaattgattgtaatgatgactgcataactctctgaaaatactaaagttagtatattgtatattttaaatgagtgaattgcatggtgtgttcattatttctcaatgaacctgttaccccccaccccaaatcaatttggtactagtgattttggtactagtgatctggagacaggtactgcttggtttcagatcactggccagggttcaaggcctaagagaatcaacagcatgtccttttcatagaaaaagagatttatattttaaaagctatccttttcattagtttcaagtctgtaaaattaaatgaaaaatctttcactgcttaaagcactgacagatttatattgaggaataagaccttgttttctttggccccaatttctatctaaacggtctgggaatcacacccttcaaactatcaaatctcatcagatgggttttattaactcctataatgtggcttcctttctaacctgattctggtgcagcatcacagagagaagaagctgaaggaaatcaaaatattttacccccaaatatatttttttgtcatattttgaaatggctgctgcagggccaagagattgaaatggccctcattaacgtagcccaatctctccccttctaggtcttcccagatctggggaagattaactaagagcctgaggcattgaaagtctgaaaatatatatttgccctctattttctcaacatattttggcagaatttgggttttccattatcaatattttccaaaattacatgatttttaataccaaaactgatttaaaattaccatacgttggaatataaattattctattataaagatacatgcatttgtatgttcattgcagcactattcacaacagtaaagccatggaatcaacccagatgtccatcagtgatagacgggataaagaaaatgtggtacacatacaccatggaatactatggagccataaaaatgaatgagatcatgctttttgcagggatatggatgagctcaaagctgatatcttcagcaaactaatgcaggaagaaaaaaccaaacactgcatcttctcacttataagtgggagctgaatgatgagaacacatggactcggggaggggaacaacaaacactggggcctgttagggtcaggagggagagcatcaagatcaatagctaatgcctgcagggcttaatatctaggtgatggattgataggtgcagtaaaccaacgtgacacacgtttacctatataacaaacctgcatgtctcacacatgtaatctagaccttaagataaaataatttttttaaattaccttctgttttagcttcttaatcagaatatccattttcagttgatctgtttttaagtctccatggcaatcaaagtctgcatttccaaatacatttaacatatttattgtcatttccaggagtttcttatatctgcagaaatgtacagaattagtaagtcaactatttttgagtaaatatttaataattgtttaaacatctgttatggcatatcaaagaaacaaatctataaactatgttcctttcagtttcaactgaacatagtttgaaagcattctatatgaaattataatcttaaataatatgaagaacaattttatggcatatatggcaggtaaagtgatattatagccatacagtgtttttgttttgttttttgttttgttttgagatggaatttcactcttgttgcccaggccaaagtgcaatggtgtgatctcagctcactgcaacctctgcctcctggactcaagtgattcacctgtctcagcctcccaagtggctgggattacaggtgtgtaccaccacgcctggctcattttgtatttttagtagagacggggtttcactggtcagactggtcttgaactcttgacctcaaatgatccacccacactggccaaccaaagtgctgggattacaggtgtgagccaccacacctggcctaaccatacactttttgtaaataaactactcatatccatgttggtatgccaagtaaaataacctattactaaatataagccataacccagagatgagtaaccaagataaaaaagtaaaacacatacgtttaaaaagacacaaaagtacattttgatacccattgaccacagtctatcagaagaaaaaaaagtacacacaaaaagcatcaaggagatcattcaatgtagaaaaagagaagaaaacatctttaatatctgagttgaggagaaaaaggatacaggcagttttagaaaaaaggaaaggggcagagagatgtgtgacgatttaaagactttgaagaagagatctagacatctttgctgacataatgtcaacaaaatgaaagagatacaaaaccatgtagagaaaggcaatgacagaaaaatgttgattcgaatcagaaaaccaaattaagtgctcagtaaataaaataggaaagtagctgtgttcagggcttcaaagacagattccattgttttaaaaaaaatctgtgatcaaaacatgaatgttcattttactttttctttaagttatacatatatttttatatatatgaaatttatttatgtaaaacaagtttaataacatgtatacttcatgtatacaacagacgtactcatgtacaatgagtaaatttccatatgttttatatctaaaagaaaaagaagcagaaacaaaatataagctacatatcaagataaatttgatgttaacgtatgacacaaacaggtcttctttaaacaatttgagtgcagcagacgatactacaaaaggaagaaaaaatgaccacagacagcaaaaaatatcttcagaaataaaaattcaaactagataatgaagagtgcaccggacactatatgtccaaggcatggtcattgttttcaaaatcattaaagaataagtggccgggcatggtggctcatgtcactttgggaggccgaggcgggcagatcacgaggtcaggaattcaagaccagcctgaccaacttggcaaaaccccgtctctactaaaaatacaaaaattagccgggtgtggtggcacatgcctgtaatgccagctactcaggaggctgaggcaggaaaattgcttggaggcataggttgcagtgagccaagaccacgccattgtactccagcctgggaaacaaagccagactttttctcaaaaaaaaaaaaaaaaaaaaaaaaagaatattttggcattcaaaaaaaatttcaccttgccccagcagctcagctgactcccgccccatgacacacatgtctaaaaagttgtgctgtgagtttctgaaatacattttaaaatagaattcatttaattatgaaaatgcaaacataaaatgaatttgtatctgttttagtcaagtaaaattagcgttaaatcaattaataaatggttaacatgttctacaatatgaaaaccatacccagttgcctcttcttctaattcatcatttttctttcttattcgattcacattatacttcagtgatgatattaactcaaaaagttttcttaattcttcattttcttttttaggcttaaaaaaagtgtttaaaattatttttgtaaaatctgtagaccctcttttatctcaaacatattatttctcataagtggatgagtaatatgtatttaggcaggtgtataaagtgcattttataaacctgatgccaataaggtcagatttcaataatagtcacttttcttaaaactgctaaaaatgattcaaattttcatcattatcttttctgaaatttaaactgccaacaatgttcgttacaaatgagggtttttacacaaaaaatactaagtgttagttaaaaaaaaaaaagagtagttatatttacattttagtttttaaagatgctctagaaatattgtttttaatagtttaagatattccaagttttcttaaattatatcttactaagacaaattttagaaaactcttatctagttcccattacatttttcatcctcatctgtcttcaggctgagctaaacactgtcattctaagtattcacccataggtttcagtttttccctttctcttaaccatttctctttaaataaagtttattttttctataataaacaaaaacaacttttgtctactttttgtggcttttctattatcctgtttctccccttccattggactctatgacacatggtctcattcagaaatattttttcatcaattattgt

SEQ ID NO: 14 - DNA, 5001 bp, Homo sapiens
tgttttttatactgaaatctgatttttaataattccaataaaaaagtccaagggtcatgaaggactttatcctactttactcagcagagcagtgaccaaatgctccctctgctcctctgaccccgcctcctttctaaatgcagcgacctctgttcttcagccctatctctattcctctgaccccacttcatttctaaatttagcaacctctgttcttcagccctatccttttctggttttttgttttgtttttgttttctgttttgagatggagtctcccactgtcacccaggttggtgtgcagtggcatgatctcggctcaccgcaacctccacctcctggattcaagcgattctcctgcctcagcctcccaagtagctaggattacaggcatatgctaccacgcccagctaattttctgtatttttagtagagacggggtttcactatgttggtcagattggtcttgaactcctgacctcatgatctgcctgccttggcctcccaaagtgctgggattacgggtgtggccaccacacccggcagctatttcactttttaaattctctcaggactcctaaaatctcctaaacttttacctagattccctaatctacatttctagctctgacctttttcttgaggtctcttccttctagaacacatattatagacaatattctccaccacatgctcatacattgctacttggtgcagattacttttgtagatagtgaatcttgtctattttatgttggttcttattgatgttactttgagtatactgttattttctaatctcaaagggggactatctcactgttacgatactaaccagtatactttgtcctttttttcattctttcttcttttttggaccagtatactttgtccctttcttttctttttttgaggtggagtcacactgtgtcatccaggctggagtgcagtggtgccatctcagcttactgcaacttctacctcctgggttcaagtgatgctcctgcctctgcctctcaagtagctgggactacaggtgcacaccaccacgcctggctaatttttgtattttcagtagagacagggtttcaccatgttggccagactgcttttgaactcctgacctcaggtaatccacccccctcagcctcccaaagtgttgggattacagatgtgagccatggaacccagccctctttttctttgataatgaaaaccttcccatgagaatcagattatcaattgtttgcctttattttcttttaaagaatttcctttcccatagacatatggcatgatgaacatcttgttctaaagttccttttgggggacacttaactatgtcattgggaggcttcagtaagtagagatctcccttcttcccattcaagattcttcatctcaaaatggtgtctaccaaatgtcttaatccaggtagtcctttgcttagaaattcatgaaataagaaccttctcgagaagttagaggcattgattgagatggtttaaagctgccccttattatatgttttactcccaaggtagacatcaaagtggctaataattctatgtctgatatctaactcacttctatgggaatctatacaacatgttttatttatgagacagagtctccctctgctacctaggctggagtgcagtggcttgatcactgctcactgcagcctcaatattccaagctcaaacgaccctcctaccacagcctcccaatgtagctgggactacaggcatgcaccaccatgcctcagctaagtgtttaaaaaaattttttttttttttttttttttagagacagggtctcactatattgctctggctgctctcaaactcctgggctcaagcaatcctcctgcctcagccttccaaaaccaggtgtttaactggggactaacatgaagcacttagaagactacatggaacatagtgagctacataaaatatttgctattagcataataattttattgtatatcttaacaaaattgtgtgttttacgcaggtggcatgccaatggaagtattctcctatagctgcacttaatcattcttaccactgagagttgcagcaaatgggggacataatttataacttacttttctctctgtatgactcattaggcaatgactatgtatgtactacaatgtaaatagcacctcctggatggaatagtatgtaactgacatgaccagcagagacaggctaaagacactgagctgaaaaccctggactctattgctaagtcaaggctcctgaatccgttcactctgagcaactgttgctgtggtgctgccttcacaagcactctgctgagtactgagattgaggggctgtgctatccttcatcagacaagctgcacccagaactgttcagctgacagactgggagcaatccagaaacacagtaatggctacatagtgaaaaaaggccaattgagattctttttcatagagagaaaaacataaacacgtgattgaacgcatctcctgtgttagactaattgggttagatttgatatttaattgctaaaaatacatttagaatataaccttactgtgtcaaggtctcaaagaagaaataattggtatggtataaaggattgaattgtatgctacaaacctctaagctaaaatattttcaatgtatgcaaggataggtggcatacatattatatattattcccccattaagcaaatttataatgagagaaaattatcttccataaaaaaaaaagccatgtaaaattaaggactaagtttttcagcacagactagacaacgattgctaacacataaggtcaatgagagaacagtcagagaaagcttcatgaaaacaaaaaaattgtctgccaggtctgaatgaatgaggctagatgaacagaaactgagaaggcagaaaggatagcatgagcaagacaagtgctgaaatctgcccagttaactctgaggataaagtccaatggcagggaaataaaaacctgtgtccacataataacctgtaagtgaatgttcacagcagcatttttcataatagctaaaaagtggaaactaacctaaaggtccatcaactgatgaatgaatggaaaaccagtatagccatggaatagaatatcatttaactataagaagaaataaactatgaatgtgtgctaaaacatgcatgaattctaaaaacattatgctaagtgaaaaagccagtcccaaagtatacatatacatattgtatatgtatacatattgtataactctatgtatatgaaacatgcagaacaggcaaacatatggagacaaaagtagacagtggttgcctacaacaggggtaggtggagggacatggaggaaggctgcagtcatgcctaggagatgtggggtcacttttcagggtgatgaaaatgctgtgaacatactaatagatactgagttgtacattttaaatggttgaactgtctgatacgtgaatgacatctcagtgaattttttaaaatccaaaggcaggatcaagataattttctcaactcttaatttttgatgtacatgctatatcaaatctaaatatttctacagttttacagtatattttaaataaaagatagataaagaaaatgcctaacttttcaaatagtttgtaaattaacctaaaacatgcacatttcaaagaatagtataacggcctttctgtacaagttaacctagaatctgtgaaacaaatagacacagattctgtgtccattcacaaaagtgaagaaataagacaattttctggaacattccatgaaacattctcctctgatttaatctggcctgcctcatcagagaaatacaaaaattacttaaaaatactgtttaacaggaaaaaagtcaattttctatgaggaatgatgtataattctcaacttttccaagggtacatattgtaagagaaaaggtatgcaatggtttttcaaaatggtagaatgaaagtcacaacataaaaaaataattataaagatagtaaaatggaaatcattcattataatgaaaataaaaaatcaagcttctgccaaaattagtatcctaaaacatgttatataattcaactagctacagaataactgttgacatgttaaattccatacatacttgactttccacttgaaataatttcttctttgaggcctgtgtctcatccaaattaatgtgacaatgtgatataccttccagtggagactctaacgttgttaatttttttacgctgtcagccacttcttgttgaagttgtctcacaaccacctgataaaatatttttgttactgattttataaattgccttattattaaattatgttaataatgtttaattctaacatatctactttgaaaattatcaccacacatatcaattcaccttcttttaatcacatgtacacatttttatgtattactgaattcagtgagggatgcagaatatgttctcttcctgccaaattggtattctcttacttacacaacagattcattccaacattcaatcatctcagaagctcaactcagcctcaaagttcctaacatattcaatcacctgttcaaatccttccaacagattcctatctcagaataaaagtaaaattccaatggcctttgaggccctaggtaaaaaggcctctacctccctctctgacttcaaagctcctacaactccctcctgtaattactccattcccactgtatgtgaagcctgccacccctcagtctgaaaatggagatgtaatgcctaactcgtaaatcacagacagctacaagtatctttgtactgaacaaaattatattccaatgacagtcattgagccttgaaataaaaattatgacctaattattaatataaatattcaaagtaaactataaataccagtgggaagactaaaccaaatatagttttgctaagttttaccacatttctcctaaattatgattttataacaagtaggtgcctttaaaacattacgtg

SEQ ID NO: 15 - DNA, 5001 bp, Homo sapiens
ccacatcaactataattttattttttgtatgtatgcatttagttttattatagcaaagcaacttgcacatttttaaatatttaaaactaagcatcatctttcctttctagggaaacaacaagaaaatttaaaaacaagcaggaacaaaattaaaatcaacaaagtcagttccaaataagatcctacaggatcttattgactctcccattgaatagcaggactcaggtcatcattaggagagaagtaatttaaaagcgtcatcttaaactgcaaagatgtccattaaacatgccaaaggagaagccctgttgtctaaatgcccacttaaccaacccaaacatctcaaacccatcctttgctgaccttctataaccccctttttagtttagctttttctacaaataagagaaaatagatacatgttggcaaatgctaactgtccatattcatatagagacagagtgtgctctctgagcccaatacaaaggaagtaaggattttcatcgaaataaaaatttattcagtaaaatggcctttctgaacaagttaacctgaaatctaagaaatacgtatacacaggttctttatacattcagaaaagtagagactaaaaagaagataattttctgaaacattccattagacattatcctctgaattaacctggcttgcctcaccatgccaatagagaaatcattaaaaatagactgtttaacaggaaaaaaaaactctctcaacttctgtgagaaatgatgcataattctcaactttcctaaggttaaatatttaagaaaaaaatatatgtataaaaaatggcagaatgaaagccagagattaagatataggtgcattataataaaatcttaataaaattaataataaggaaaatacagaagaaagccatccactataaaattttaataacattaattatcataaaaatacaaaagaaagccatccactaaaattagtaccccaaaacactttatattagttaactagctacagattaacagttgttggtgtgcaaagttgcatacatacttgacttctcatctggtctaatttcttccttgaatcctgcatcccattttctaaataggtgcagtgacgcgatgaagcatccagcagagcttttgttgctgatcctttgtttaagacatcatctcgtttttgttgaagctgtctcacagctacctgataagatgttatttttgttactgattttacaaatcaccttattattaaaccattaataatatttaactctaaagcatactctttgaaaaatatcaccacacagaccgattcaccttcttttcctcatgtgtacacattcctgtgtattactgaatccagttaaggatacagaaggtgttatcttcctgccaaactggtattgttattcacacaacatattcagcccactagtcattcctcccttgatgaatctgcaatgcttaaaaaccttctgaagtctcaaaaagaaatgagtatgtgggtgagactgatggtagtaaattatacattgtggaatgatttccctctttttttaaattagaaactcaaatcaacctcagagttcctcacattaaatcatctgcttaaatccttccaatagatgtctatctcagaagaaaagtaaaattccagtggccttagatgctctaagtaacccgccctccacctcccgccctgactcagctgctatatctctcctccgtactcactccattcctactctacgtgaatcctgccactcctcgttagtctgaaatcctccttagtctgaaaatggggatccagtgtcaaactaataaatcacagatagctatgcctctctttgtcctggacaaagttatatccaaatgatagtaattgagccttgaaataaaaattatgaacaaattttttatttaaaaactgaaagtaaattataaacgccagtgggaagattaaatcaaacatgatttggctaaaatttactgcatttgccccatattataatagaagtaaaattagatgccttgaaagaatagaatggtcatatctatacataatttgagattgaaatagtttcagatttaagtcaaattgacatgaagaaaaacaaaattttaccaactaagacatatttaaagctactgaagaaaagtaattatgaaatagggaatacacttcagttcatctaggaaatctgaaattcactgtcaaagtaccccacttaattgaatcaatttcaaaataccattttaggtatgagcatttccatatacctgatttatcatggtcttaaaatgttgcaacataaatacattaaaattattacttcagcagtataagactacattattaatgttagtctatgttaacattttataacttaaaattttataagcgacacattgactttaatcagaggaaagcatctctcagttctaactttgacttgctggagacaaggaatgtttctaagcagatatatttatcatatgtatccttttttatattcaactagatccaacattcagctgtaaccaaatattactttaaattttacttcaggaagtttgaaaaatacttatttttcttgatacttacttctctttctgctttctctttttcatattggcattctttttctttcgaatgattcagttcattgaccaacattttattgtcttcttctagtaaaagacggtgctttctgcactcagcttgaaggttttgtactctagcatcacatctggcttgaatattaagtattgctttttcttgattgtcagctttgttgcgagcatcatccagttgctgttgaagcaacatattttgtttttttagttgacaaaatctttcctgtttttctatgcatttttccattgtattgtatccacttttgtacattttttcaatgtccttcatttgactctgtttttgctttagctcactttgcacgtgttcaaaaaccaaagccttttctttcagagcctctcctgtgtaatggagctcagttttgaggactctggacttactctcagctttagaaagttgcagagaaagaatcagaacatgagaattcaaattttcctgtaagtgacgacatttatctactgtgccctggaaagcaagctcttggtctctttttgatgagtgactttgatcatgatcacatcgagcagcattcagtctacaacggtatgattgcatttctgtttccagtctttgcctgctctctctttgcttctccagtttggaacggagcgttgtgttttcatctgtcagagcagcaagctgtccactataacaggctatcgtttttgctaatgtttccccattccgttttagagccttttgaaggtcttcatgctttcttttcacaatttcaaagtcttttaagtatttcttttccaggttttggttttttattgtgtctttttccagcctgagcctggcaatttcatcttgcatcaagcggttttcatgcagcaggtcttctttttcatcagtttcagaaacctaagtaaaacaaagcaaacttgtaactagtatccaataggataacatattgtgattgcttctgaaattaaataataacccgtacatttatacaatgagaggttgccataactggatatctaactgggaaaaaagaagttaagtcaaaacctcaaacctcatacagcataaattccccaaagttcaaaagtttatttgaagacagtgaatccatgaaagcaaaaaagaagccactagataatttttttaaatttcaggataaaaaaaggcttttactgaattacaacaaattgcaaggcataaagaattaataactatgaccacattaaaaaattgggtttacactctaacatctaaactatacctctccctatagtgagagccttagcttggcagatatttggacagatgaatgacattttccaaattctttaagttccctttttctaaaatattgtatagatattctacttttctaatattgttatggtcagttttaagaatgacatttattgataaatgataaagctaggcattatactaagcacttttacgtgcacaaatcaatgaactcatttagttataattctatagcaaaaggttaaaaatataagcaagctgcaggatttttcccagcttttctgactctattcctagtgctcttccaccaaatcagtaacttctgtgaggtagatatatacatacaaaaataatcttttatttcaagacaccaaaagtcaagaaaattagatctataaaactcttcttagaaaatcatgacattatttgctattgtgataacttttattccttttccataacatttgaaatgtaattaacatgaaataggggaaatatgctgaactatgtcactaggaacaaaatacttacaatatcattaagtatatattgtagaatagcattgttttcaaaaggcctttgaactaaaataaaatatttcaagatttattataaataattatagctataaatgccatgattcatttttaagatgaaataaaatttggggattgttcaggcctaaataatatatgttaaatgaaagagatggtataagtaatattaataagagtagaaatatgaagttttaccaaacattaatttacctgatttgaattatttcctcctgtcttcaattccacctctgctgatttgagagccggtttaattggttttgtcacatcagcttctatcctatattgctcttctgttattcttaacttttccctaactttttggtgcaactcttcaacatttcttcttttctttttttcttgctgtatggcaaatctgtaaatatacttatcttagaatttatcttatcagtgaggactaagctctaattttttatcttgcccaaattcctacctaaggggtccagggagtcgtgccctacaaaccatggattctcatcagatgggttttatttgaccctgtatattgtgacttgcttttcaatctgac

SEQ ID NO: 16 - DNA, 5001 bp, Homo sapiens
ctctggcataaccttacgagacaaggaagaaaatatttaatccaaaatatatttccttgccatgccttgaaattgccctgcaaagtctcttgtgggaaaaatccacattctatagagaaccccctttcccctttgttttccttcctttctatgcagatccaggggatattcagctgagagccaggcacccttttgggtccgataagaaacattttacaatctgctctctctgaagtctgctgagagattcctctgcacagtaaaacttggtccccacaatcatttatcttaacctgaacatttctttccattaatcccaggtcttcaaataaactcaagcaattgtcaaccagaaaatgtttaaatttacctacagcctggaagccccagctttgagttggcctgcctttctgaaccaaatcaatgtatttcttacatgtatttgattgctgtctcatgcttctctaaaatgtataaaaccaagctgcaccccgaccacttcgggcacatgttctcaggacctcctgagggctgtgtcgggggccacggtcactcatatttggctcagaataaatgtcttcaaatatcttacagagtttgactctctttgttgatattagaaaataaaacattcatatgttggtttattatcctaataaagtttctatgttcttaaatactatttttctttctagttctcatgtttttaatttctcacctcaatctcatccaaagggcatgtataagttgaaatgtattgataaaagaacatcctgcataagtttctattactagtaactctagcaaatattatgaaaaaggacgttgaaaattattcagtaaagttacaagataaaaattatcttttcttcacagtaattactcctcaattaggatgaatcatttagagttaattaacataaagttactttttataaacaagttggtacattcactagaaatacattttcatcttcatgaaacattcattgcaagtatccctaaacataatttacattgcaagatagcattttcgatgtctttatgaaacatatatcagcagattactgtaatccaagactaggttaagaatgtaatatgttaccctacactttttaagattgttttttgggtaacactttcagtctatcctgctgattagtatgtactttataaccaattgtaaaatctgttttggaacaacacaagatctaatatttaattaaacaataaagaataatacatgtcttcagcataaaactgaattaattttatctacatagcagagagatgttgaataagctaatcagtaatcactttacattttactttttattccctgcatattaagaataaaactggatacatttttttttttttttttttgagagggagtctcctactatcactgggctggagtgcactggtgcaatctctgctcactgcaacctctgcctcccagtttcatgtgattctcctgcctcagcctcctgcgtagctgggattacaggtacaaccaccatacctggctaattttttgtatttttagtagagatagcatttcactgtgttgggcagactggtctcgaactcctgacctcgtgatctgcccacctcggcctaccaaagtgctgggattacaggcatgagccactgcacccggctgataatttttaaaataattattctgggtaaagaaaaatatctgttttatactctgttggttgaattataaattaatatgaacatccttaagaacaatttagaaatattgatcacagatctaaaacagatctaaaaaagtttctatactttaaccagaagaatttatccaatgtaaataattagaaatgtagaaaactatgtgtatataaaagatgttccttgtagcattattacaaaaactttttaaaacctgaaattcaattcatcaattaaataatgagatttccaaaaggtaaaattctatacagccattaaaactatgatttaaaagaatatgcatttaattattagagaagtattcacaattaagaacttgtgatattatatccaataatttcacactccataagattaagaagctttcttccctgttaaatcctagaaggaaagttcgcaattacaaaacttctccttatacgtctttaatataaaacaaacagttcaaacatttatttaaaactaggtcatacctcaaactacagagttctttttccaattcaagtatttcatgctttaactgcgattttatttcttctttttcagatattctcttttgtagtacactagccttatttttcagttttcgaatttttactctaagttgctcacagtggttatctttaagttttattaatcttttccataaacaaaatgtatttttaattttcaataggtgaacacaatctgtaaccaggaaaaaacaaagtagagataaaatacatgagtagatttttggatataaaggactgtgcatttttaacatgtattcattcatacgttgaacaagtatgtacatattgagtgcctacaaggtggaagatattatagtaaggtctgcagataagacaacacctctgctattgttttagcttaaagtatagtgaagaaccaagataaaaaggtgacagttataaactcagataggtcctgtaaaaaaaaaaaaaaaaaaaaaacatagttatgtgattgcataagataatttgatctatacttcacccagggaagatttccctgaggaagagatgctacactgagaaatgaaggatgagaaagaagcagttaagcaaagaagaaagcaaagcactctggctagtttgcagcatgtgctgtgctgaagctctgctgcaatctgttactagctctgatggagtaacagatactgatttttcatcttatctgaatgaataaaaaacaaaacagacacaatacattaaactgattttcaacacagtggacttcaggcaatgaagatggtaggtgatcactgaaagacagaaaacaaatacagcaggccttacaaatatcccagctcttttgacagagttttgacggaggttcgaggccatcacaaagggagaaaatctgacatagagctggggtgatgacgctgagaggccagtaaaaccaaagcagatagagatcacaggacagaaaactggagagaaaaaagcagtacaggaaacaaatcctggagatgtgcagagattccctcttgggtatttagtggagtaatgaaaagtgcttgtgtactaggaaacttcctaagaacaatgaaaaataaaataaaaaaaaacaacagttaaagaacattagcagaaacgatgtctggggttcacacaatgactggaagagggtccattcccatgagccaggccaaaataccgcatacttcacaggacaatgaatactccgaaaggtcttgcctcaggagtgaggaattaccccaaatctaaaagcaagaatggaaagattataagtaaatctctgtactccaaataaaactcaagataataagtggaggcagggaaggtttttttttaaaaaaacacaaaccatacttgtagagacacaaattacattgtcataagtaaaaactatagtggatggaaataaacacaaattagagataacaaaggaaaaattcctaaatttgacacgataaactgcaagaaactttcaagcagctaatagataactcctcaaataaaaaagaagagacagaaaaaaaattaaagaaaaaatgaccaaaaatattctaaccttaacacaaaccataatcccacagattcaggaaggaagtgtctgggacagaaaaaaatgaaaatgtatcattgtcattttttataccatctaggatgtataatattactgaaggtgaactgtgataagttaaaattatatactaaaaatcctaaacactaagatagcaaaacagttatcgctaataaacccaaaaatatatataaaattgaatcataaaaaacagttgactaatctaaaggaaagcaggaaaagaaggggaacagagaacagttgggactaatagcaatcacacagctaccagacaaacataactatatcagtaatcacattacaaatgacacttgtctaagaacctcaactataatacagactgtcaggctcagcaagaaagcaagacccaactacaggctgcctataagaaatgcactttaaatgtaaagacacaaattggttgtaaggatggaaaaagatacatgctaacagttggcaaaggcagctgagcaggtgtggctgtattaataccaaagtagatttcatagcaaaaaaaaaaaaacattccagcaataaataacaaaggtcatgtcacaatagtaaaaggttcagttaatcaacaaaacataacaatcctcagtctttatgcccctaataacaaaccagcctcacaatatatgagaccaaagtggatagaactacaaaaagtgacagacaatttctaggtaatctgaggtttcaataccctttactcaataagtgatagaacaagaaggcagaaaatcagcgagaatagacttgaacaacactatgctttccaagtacccacggaacacttaccaaaatagaccatattttaggccatacaacaactctcaattaaaggattgagtcagaaggatttaactcatacaaagtatgtgccctgaccacaaatcaatcagattaaagaccgataacaaaaataactctgggaaatacacaaatatttggaaactaagtaacacacatctaaataaccctgggtcaaacaggtaatgaaaatagaaatagaaaatagaaaatattctgaactgaataaaaattcatcaaccagaatttgtggaatgcagctacagctgtacttgaatacaaatttttagcactgctgaatgtctacattagaagagtcttaaatcaatgactttgacttctaccttaagcaactagataaaagaagagtgacataaacccaaagcaagc

SEQ ID NO: 17 - DNA, 5001 bp, Homo sapiens
tgtaaagaacttgcacaccactgaaaacatattagaagactcttgtttaagaaactatattggcttatcttaggagtattctatcgttaagtgtttaaagatatgactttctgtttagccagggtctccaagttccatataaatatatatatatttatatatttttatatttttatatatatttatatttttatattttatatatttttatatatttatatatatttatattttatatatatttatatatatttatatatttttatatatttatttatttatatatttatttatttatatatatttatatttatatatttatatatatttatttatttatttatatttttatatatatttatatatttatatatttatatatatttatttatataaatatatattatttatataaatataatataatatatattatatatattatatattatatacattatatatattatatataatatatattatatatattatatattatatataatatatattatatatattatatattatatataatatatttatatataataaatattatataatatatttatatattatataatatattatataatatataaatatagagtattatataatatattatataatatataaatatataatataatatttatatattatataatatataaatattatattatatatttatatattatatataaatatatatatattttttttttttgagacagagtctcactctgtcacccaggctggagtgcagtggtacgagctcagctcacttcaacctccatctcctgggttcaagtgagcacatccagctaatttttgtatttttagtagagacagggttttgccattttggccaggctggcctcaaactcctgacctcaaatgatccacccgcctcagcctcccaaagtgctgggattacaggcctgaaccaccacgcctggccacacactacatttaagtgtgcaaggaagaggcaacgttttgttccttagtaactgccttaaacttctccattagcctccccattctgagtagctaggaatgtaaatcaaccgattcaaagaaaacttggcctcttgtgatttaaattattttcctttttctttccatttaaacccgcctttcctaggtaaataatcagtcctccaaaccctccactttctctgccttcactgtcttggagagcatattggggagcttgtagggtcctcatggctgcagggcatcttagagctagatggtgtcctctgggtccttgcaggactctgcagtgatggggaccctgctcgtcaggtcatttctctgcctcactggcatctgctgccaatgtctaagacttgggaaccttggtctgttccctgtcctgctccaatagaagccagcaccccttccacgggcaccagagtggctctcacacatgtcagctacctgtccctggctgtccaatcccaggacagctactttattacaatgtcaccagcaatcttctatgaccctgcttctgggtgccctctatgccacacaggtgccaggaaggaccctggagccccccttcggcctcccttggaagcctctcatcaggggtgattgcactctgattctgctgccccatatcatcatgaggtggggggtcagaggtcacaggcatcctgcaaggctgcttctctctggatttcaatagaaggagaagtgaaattcgtcttttgaacagattcatctctagaaaccctctgtccatgttcacaaaatctgtcttttgagccttttgttaccctaaagagctaatggagtgaactgatcaatgatcttttggttctggatctacattcaccttccctggcgtaaaatgcttatggtttagcctaagaaaatgaggacacaagggaatgcagttttaatgggaaatgaaaagcactgctttcttgttttcaaaataatggtcccattacacgtacaaatatcgatttataaggtggggagtttgagacaccacaccagtgggcaagcaactctgattttcagattacttaaaatgttttgtacccagatacagacattgctcatagttatccagtttgcccataaggaatttcattctttcccaccgcctcccaccctccctgcaaaagctcctcaggattctccactgagttcataatcttctctgtgatctgcttatgtccctcactgtccaacacagtgagtatgtttggtgtttcagtgaagttgttgtgataatcagggtccctttgaagtagaagagcattttttttttggctgaagactcagcagcacccttattttctctaaattctggttcccaactggctttaaacacaaacctccttactgctcctttctctgaattcaactgtaagcttcccatttcctgttcaatcaacacgtacccctctattgttgtcttactaggaagtagatttattcttatcagtatttcttagccgtttggaggcatggacccctgtgaaaatctaatgaaaactaataatgctcatcctagaaaagtgtgcgtgcataccaaagtttgtgaacaatatcaggggtccacagaggcccatccatggactccatatcagccaagatcccaacttagcatttattgtctcagctatcatgaaaattaaaatcagctcatggggggaaatatgtgtgagttgataacatagggcagggattgcttaaccctttgcaggctaaaaatacctatttttctctggagatgtaaatatttgttaatctacttgatgaatattatatggccaaataatactgttatttttgaagttcttgtggcttttaataatggtgcttccagttatgctcatggtatcatctgggcatcagatctgtgtgcatacgatttgtctttctgtgaactcaagaaccatcacttagcattatgattcttgctgctccaataaaacttgtatgtcttgataatctttaggattccattctttaagatttgctcagttatctattctaattccccttcctgacaatatccacctcaaccaaccagatgagggcccttcctctgagtctcatcaaaaccttacatgtggttattctgttccccagtgtgttacaattgtctggttcaatgttcctctctccaccacaccgtcaactccagtagggcaggaacagtgtcactctcacctttgagccccagtaaagcacagtgctcagcacatagtaggtgctcaacatgtgtttgctggatgtagactgaatcacagcaattcttcataatttctcatgtgataaatagacatgaaacgtggacaaatcatgttaagcaggtttcatcttttgggttaactattttagccttgtaaattagtctttcattgtctgtatattcaagcaataattgagccaaagcttaatattaataaaagtaaactagagttaagataaattgacagttccatgtgtagagatgataagagaaggtcaccatggctgagtttgtaactagttgctgacttcctgcataatttagtgcatactacaacagtagcagaaaatctatttgatagttaaagtcctattccttagactggtgtttaacgctctgcagactgacccaggcctgatttttccataccacctggctccccactctctccacttctgaaccttatccctcaaactatgcaagcagcttcatgcaccctgggtcctattggtcttgctgcttctacatcaagaatgcctgtcccatgacgacatattaaaatgtccctcatattttgagaacctgctcagaggtcattcttcctgtggaccacctgcacatcccaggcaaaggaattcccctttctcaaacatgctaggagcacaggttacttcacatgagtccctcatcactgattttcactcaggaccagaaaaaaaaatagtcacttccaatagatgtttttctcttaattattcagtgatatttttcatttctatgtcatctgttttcttctaatcacctttggatagatgtctccctttagaatttatccaattacaaactgtctcaagtaaaattgatacacaaacaaagtatgaaagaacatgtcacatatctttttaaaaaagcaagatatccagattattgttgcaaaatgttgtgtgatgaagtccttcctgctgaatgagtaactggatgaaaagaccatacttctttttcatccttactaatattgttgataatatttactcatcaattcttgagcttgagaaaattcacctaggacactgtcatctgaagactcttagtctgagatttcaataatataaccaatttcaccattattgttagaatctagagacctgctgtcctctttgaattcatcttttgagtcatctagtgattgtgaaatgttgttctctgtcagtttttggaattttcaattgtatgcagtgaaagctaaaagcagattcaaaatagtgatgatttatgtcactattgaatcatccttctaggcaatttcattattctatttattttttcatctttctttagcataattgggaataattggtgagtaatgatgagaaataattccctggatgatgaaatagcaaaatgtttcaaaagataggaaaaataagatcacaaagatcccatgatgtatcttagatttataaaaaggtcaagtgaacccatatggtaattgtaatgagttatattttatttaaaacataagtaagttctcttcttgttcttcagaagccctctaagagaataaaagttataaaatatcaaaccgtacaaatacataaaacaactccaagaggaaactcaaaaagtaaaattgggtccagtgaccccgatggtatgccatattatgtacatatgaacacttcaacacacatctgtctaactgaaggccaagaatagagtaagagtcacactctctatgtcttcctggagttccccaagcctggtaa

SEQ ID NO: 18 - DNA, 5001 bp, Homo sapiens
tgaaactttcttcccttttatgggctgacccctcctctacattctgttcatttattgtgactttctaggtgcatgagccatgtggtttattacatttgcaggctggttgccagtacttagaattatcatgccttgaaaatggaccatttaaaatgatttttcacatacagggtcttttatattttgttatcaaagtttctccattttgtttttcatatttatgtaccataatcaatctgggattaatttttgtgtgtgtgtgagtagaaaactaatgcatgtgttaatttttttctgcatatttgaatatttgaaatatttcataattaatattaaaatcactctaataaaagtaatacttgtttattatagaaaagttagaaaaatacaataaaaataaaaacaaaacttcccctgtaataacataactcagcaacacttttaatgttgtgaggtgtttccttctggtctttttttattttttggtaaaactgagatcaaactgttttccatttttatcacttagcattgtcttgtgtgtatttccttgtatcatttgagttctacaaaattatttttaatgatatatgtagtttatcatataggtgcatcatattttatttaaccaggaacttactgttagacacttaggcttcctccaagttttcaatgtaaatgttagttgagcattgaatattcttgtacaaatatttctgatttgtttttgaggataatttctagaaatgaagttcttgggtcaaaaggtatgaaaaattttaagatctaagaatacagttagagaaagataccctctggaaagtgtgtgccaattttaatcccaccttctccagcgacgaatgagctgttccatcctcccataggcaccctcctggcacttttgctgaaatacatgaagactccaaccttagctgattcatgtagtcataacaagatcacatgctgatgagaatacaaaatctggaaaaagcacatagcaagaagagaagtctgtaatgatttattaatatagtagcctcggtcctccttattaaatttatttggcaaaaatttgccattctgccctgggtgataccctgatacactcagctcaaaccaagagccaggcatagatgtttaagacataagaaggactccaacttaactggtgctcagggcaaaagaagaacacaccaggacatctgcccctctggttaggagaggtcagagggggccagatcactcgttaaaacatttcagtgtctgttatgagccactcattgcattggaggtgggaacacaaaaatgaccaaccttgacagaaaattacaatttggaacactaagggctcttacaggatctagcttcagggcactatgaaatcacaggtaggagtgctccatgtaacctgaggatgtcagggatatagtttcccagacaaggtatgtctaggctgatctttgaagaggaagagggcttggccaggcagagagaaaaacaggcatcctacctaactagctatagggcagacagactgtggagtaaaaggtgaggagtgtgatggaagggactggaggaggaactgtatgagagaaggctgaaggaggaagggactgggttatgaaaagcttcacgtggctttctatggagtttatattctttacaacaccgtatgtgttctgatcccatcacctttctgatcatatgtcctatccctcccccatcccaaccactctgctccaaccacattggtctccttgccattccccaatcatgcttccacctcaggacctttgcacatgctcttctctctgcccagaatgctatcccccaggtgtatgtttggctttcttcctctcttccctcaaatgtctgcctgatagtattacctaagcagagagattacgtctgataaacttggacaatatagcatgctgctcttgccacctactctgctgttctctgtcttctaactctgctgtatttttcttctagtatttattttctatctttgaccctaacgtctactagaatgaaagctccatggaggtggggactttgcttttttattgctttaccaaataggatctattgaatagtctattccttatgcctagaatagtatctgatgcatagcagatgcttaataaaaatttgttaaatatgcgagtgaattttgttataaagagaatgaggagccattgaaggtattttatgttggagaaggatcctcagatgtgtattttagtcagctctctgtgcctgtagggtggaggatgaggccagtcaacctgaccaggaggttcccaaagtcatgtgtctgggttaaggtagaaaggttggggtggagaagagggatgtcttccaaaggaattaagtaggaagcatatttgcctggcctcagtgcctgtttgaatgtgggagctgagagagcaggcaaatgatattccaggttattgatttgggaatctgggtgggtgctgccctaacttagatcagaggatgctggcaaagattcagttcaggaggaatgacaatgaattcaggttcatgtagaacatgctgggtttgaagttctttggcatgtcccaagggagatgtttagcaggcaatttggatattgcagttactggagccatttgtggtgagatcactaagggagggtgtgtaccacgagatagaggagtattaagaatggaaccccagggcatatcaccccagagggaatggaggatgtgtgaaacaggaggaaagagtgtctagaaggtgggagtggtcagtaacatccaataacaatacaagtagatgaaataaggactgaacaggttaaattgcattttgcagctgggaagttgccagtggagtgctcagtacagggaatggaaaagaaaaatcgaggcagaatatggactacttgaaagagtaggaacactctgggaagagtagagcaactaaatgtgaagagaatgagcaagacaaaagttgggcagcaactgaaagggaaaggaaggtgattttaacaaaattaggtctggaaattcttcacgcttttaatgttgagataaagattcataagtagtgaatagtaagtgcagagaagtcccacaaacccctcacccagtgtccctagtggttacaactgtacacaattatagtacaatatcagtaacagggatttgactttggcacaatgtgtgtgtgtagttctaagtcatttttatcacatgtgtaggttcatatttaatatgatcatcattgtattcaaatacaattttttttagagacagagcctcactctgtcacccaggttggactacagtggcatgatcagagtccattgcagcctcgaactcctgggtttgagctatcctcttgcctcagcctcctaagtagctgggactataggtgtgtgccaccatgctcagctaattttaatttttttgtagagatagggtctcgatatattgcccaggatggtcttgaactcctgggcttaagcaacgatcttcccacctcaaatacaaaattattccattatcacaaacagctctttgtgctacccattgataatcacaccagcacctcctccctcccatcatctctaacccctgaaaaccactattctgttttctatttctataattttgtcactgagaatgttacacaaatggaatgataaatcatatactattttgagattggcataatgccctcgaggcgcattcaagttgtgtttatcagtagctcattcctttgaattgctgagtagtagtgtttgatatagatgtactacaattctttctccaatctatagttgaggaacatttgtgccattttctagtttggggttattacaaataaactattaacaatggcatacagctttttgtgtggacagaactttttatttttctgggataaatgcccagtgtttcaattgctatattataaagcatttgcatgtttagttttctaagaaactgctaaactgttttccagacttgttgcacaccattttatagttccaccagcaatgtatgtgtgatccagtttctctgcatcctggccagcagatatgtagtgatatttcattaagctcttaatttgcattttgctaatggcaagtgatgttgcacatcttttaatgtgcttatttgctatctttataacctcttcagtgaaatatctctttacgcttttgtccattttctaattggattgtttgggttttttaaaaatgttaaattttgagaggtgtttgcatattgaaaatagaagtgtttcagatatgtggtgtgatggttaatactgaatgtcaacttaattggattgaaggatgcaaaatattcatcctgggtgtgtctgtgagggtgttgccaaggggcttaacatttgagtcagtgcactggggaaggcagacccacccttaatctgagtgggcaccatctaattagctgccagaaaatataaagcaggcagaaaaatgtgaaaaggctagactggcctagtcttccagcctacattttttcccgtgctggatgcttcctgcccttgaacatcagactccaggttcttcacctttgggactcagactggcttccttgctcctcagcttgcagatggcctattgtggtaccttgtgattgcgtgagtaaatactacttaataaactaatattatatatataaatatatatataatatatataacctattagttctgtccctctagagaaccctgactaatacatattgtttgcaaattttctctagatctgtatgtagcttgatcttgggttaaggttaattttttccctatgggttcctccagtaccatgttgaaaagacaattcttcctccattgaattgcttttacgcacctgtaaaagataagttggctatatgagggggcttcaaaaaattcatagaaaaatgaaattaaaagataagaaatttactaactaaagaaaaatgggtgccctttaaagatttcttaagactaaaa

SEQ ID NO: 19 - DNA, 5001 bp, Homo sapiens
aagaaaaaatcctattattatatcaattgatgcagagagagcatctctgcatctaacatctgtggtaaacattcatgataaaaactctcaggcaactagaaaaagagggtaactttttcaatttataaggaacatcacggtgacagactgaatgctttctccctaagattgggcacaaggtaaggatttttgcttttactactcttacttagtaaactgctggaagttctagcaactgcagtaagtcaagagaaaaataaggcatatagattagaaaagagaaaatagaactgtctctattttcagatggcatagttatttacattaaaaaacaaagaatttattaaaattaaaatatcctggaactaagaagtacatatgtgtatgtgcgtgtgtgtgcagttgtgacagcaaggttgtggtctacaacattcgtgcataaagatcaacctagaactgtgacagcaccattacagtatacagcactagcatccaaagattaatcacatttctgtatactgacaacgaacatgtggaaagcaacaatttagaaatcccatttacagtcattccatagataataaacctagatataaatgtaacaaaaacatttacactatttatttgctgaaaatcataaaatgctgattacagaaatcaaataagacctaaataagtggggaaacacatcctgttcatagatgcaacatagtaaagataacagttgtcctctaagtgatttaatgcaattgctatgaaagtccaagaaaagttttttgcagacatagacaaacttattttaaaattaatgtgaaatgtcacagggtctataatagctaagcaattttgaaaaaaaaataaagcaggagtcagcctactcaatgttaagttttattatgtaactgtagtaatcaagacaatgtggtattagcataggaacagacacatagatcaatggaacagaatttgaactacacaaatatgcccaactgcaaagtttcaaaagcaatatcatgaaggaaggatagcttcttcaacaaatagtaattggacaactgtaagcagaagaatgaaccatcaccaaacctcatgccttacatatttttaaaaaactcagctgggcactgtggctcacgcctgtaatcccagcactttgggaggctgaggcaggtggatcacctgaggtcaacagttcaagaccagcctgggcaacacgttgaaaccctgtctctactaaaaatacaaaagttagctgggcatggtgacaggcacctgtaatgccagctactcgggaggctgaggcaggagaatcacttgaacccaggaggcggaggttgcagtgagccgaaatcacgccattgcactccagcctgggtgataagagcaagactccgtcttaaacaaaaactcaaaatggatcatggattggagtgtaaagtgtaaagctataaaacttttgagaaaaaacatcataggagaaaatagatagaaccagtcacatagccaacaaagtagcaaaacgggctgggaaatttgcagggtattttaaaactttttattaaatgaaggagataaaataaaaatacaaattttattttaaaaatataacattgatagaaaaagagaagaatgaagagctaagtgaagagtcttcagacttgacaccaaaagcatgtatcataaaagtgaaaattgataaactggacctcattaaaattgaagatttatgctcggcagaagactctgtgaagaggattaaaagacaagctacagaggagaagaaaatatttgcaaaccacatatttgacaaaggacttgtatctagactatatagtgagttctcaagtctcaacagtaaatttttttaatccaattaaaaaatgagcaaaagacatgaacagacatttcccagaagaggacatacaaataaacacatgaaaaagtgttcatcttccttctccattagtgaaatgcaaattagccattagggaaatgcaaatgagatgtgactacacacctgtcagaatggctagcttaaaaatagtgataacatcaagtgaaacaaacagatctgtatgtatcttggataaattttacaagaattactttaagagggaagataagccacaaaacagtaacaataatactcagcaacacttactgagtatttatatgtcaaacactgcttcaagtaattaatatgcataaactcaatattatctaaaactgtatgtatgtttatctgttttacaattttatatgatttatggatgcatatattgtaaaagtaaaaagaaataaggagtatctcaacatcaagtactaattattaatacctctggaaagagtagatgaaggaaggaatagatggagtaaggcaattcttgagtattttttctttttctttttctttttttttttttttgagacggagtttcacccagactccagtttcgccctgagactccagtgcccaggctggagtgcagtggtgcaatctcagctcactgcaacctctgcctcctgggttcaagctattctcctgcctcagcctcctgagtagctggaattacaggtgcatgccaccacgcccagctaatttttgtatttttagtagagatggggttttgctgtgttggccaagctgatctcgaactcctgacctcaggtgatctgcctgcctcggcctcccaaattgctgggagtataggtgtgagccaccgggactggccgagtattttattttttaaagagagctgacattaataaggcaaaatgtaatgtctgtttagttttgatggagaatatatatgtgtctgttatgctactttctgtataaatatatatatatattttcaagttatatatatatataactaaatatatataactaaatatatatataactaaatatatatatttagatatataatatatattacataatatattatatatacaatattatatattgtatatataatatattatatagtatatataatatattatatacaatattatatataatatatatattgtatattatatattatatacaatataatatattatatcatatattatatatattatatatattaattatatatataatatattacatatataatatataatatatattacatatataatatataatatatattacatatataatatataatatatattacatatataatatataatatatattacatatataatatataatatatattacatatataatatataatatatattacatatataatatataatatatattacatatataatatataatatatattacatatataatatatattatatattatatatataatatataatatattatatatataatatataatatatattatatatataatataatataatatatatcatattataatatataatataataatatattatataatatcttatataatatatattatatcatatatattatatatattatatattatacatatatattatatattatatatattatatattatatcatatatattatatattatatataatatattatatatattatatattatatataatatattatatatattatatataatatataatatatatgatataatatatataatatatataatatataatatgtatgatataatatatataatatatataatatataatatatatgatataatatataatatatataatatataatatatatgatataatatattatatatataatatatatgatataatatattatatattatatatataatatatatgatataatatataatatatataatacattataatatataatatatatgtataatatacatattacatatatataacatataatatatatatataacatatatatattatatatataacatatatatattatatataacatatatatattatatataacatataacatatatataatatataacatataacatatatataatatataatatataacatatgtataatatatattacatatataatacatatatataatatatataatgtatatgtattatatatattacatatatataatatatataatgtatatgtattatatataatacatatatattacatatatacataatatatataatatatatgtataatatatatattacatatatataatatatattatatatgtataatatatttattatatatatattacatgtatatatatatatatatataacttgaaaaaaatatgtaaggaggacattaggcttaaccactgaagcaacactcagtgaacactcatgccctggaccaggccctgagtggatgctggaggattccagggaggtcagacaaggtgccatctgcaaagagctcctattcttgtttgggaggcttcttggagaaggtgacaagtgatttccttatttgaaggataaacaaagagttaagagttattgacttaaaaatctattgatgagctgctgtgttcagtaggcattcatctaagtgttttggatagaactgtgaaaaatgtagatcggcacttctcaaagtgctgtccccataccaacagcatcaacatcacctgaaaatctgttagaattgccaaatttcaggttttgtcccaggcctaccaagtcagaaactctgaggtgaggccagcaatctgtgttttcacaaggtccccagatccttctgaatgcctgctgaagtttgagaaccactggtagagaaagtcttggctctcagggcttgcatttgtgtgtgcttgtgcacgtgtgtgtgtgtgtgtgcacgcttgtgtgaatgcatgcacttgtgtgtgtgattgggggaaagggcagacagcacacaacaaaacaggtgagtaaatgagattatttcatgtagggataaatgttatgaagagaggtttataggggcttagaaaaaattttaggaagtcag

SEQ ID NO: 20 - DNA, 5001 bp, Homo sapiens
tcggctgagaagaaatttacccatgcattgctatagacttttagtttccttctctctttttcaccctgctcagaataacaaattaatgtggttggtgagctagccagaggaagcatgcctcacatgatgacaggggaaagaaaatcctcctccctccctcagattttgttcccttaaacacctgggcttcaaaatgatggtgttgtcaactaaagttgtggccgtgctctctagagaaaccaagagtctatgaaaatatctctattcctaccttatgagaacactcccacagcaccaactttatcttcctagaacctctggcatgtagtttagcttaggtttcagaaggataagaaacaaggagcttataaataaaactaatttctaatgtaaactgcaacttcctaagatattcacatttttgtgaatattttttgattccacattttttccaaagtatggtatggccattcacgttacccaatataccacacaggaagcatggcaagacatgttaatgacagcataaaattccaagtaatacatctaaaagtgttataaatttaaactatgaattctgtttaccattattaaattcataagaagtcaaagcccgaaatttaaaccccaattctgttttaacttaaataaaaagctttatgttaagcccaaaagtaattagagtctctcaattttttccacttcaatttttttctctgctgaatctcaattagatggatcttggtgaaacatctagagaagttgggcctccctgagagattataactttaaccattttactggaaggcgtatggtatattcaggacctcccaatttcaaatacttttacttaggtctctcatgtgccctaagctgtgaaaactcaaaagaattaataagccatataaggttttcacaatatgaccccacactctcaatagaggaaaccacagcttctacaagagttaccacaagtaaagtttattcttataatgcagtacctggttcaattacacccaagttatcattaaaggcaaaaaacagaagagtaattctcgttggctgacaccttaccagaatctcaatcagccaagtccaattgtccagagtttaagacctaggagcttatagtccattcgcctagatgtttttgtcaattctgatattgtgcttatcagatggagttgggaatattcacctacctatacaacctgactcccatctctctgagtgacatttgagacatttgaaccttcttgaaaagtttacaaatttgcactagtaataacggcagtggttccttccccccatttagagaagttgagcctcccttagtgaaaaaaaacttattaaatcctccccttgggaccccagccatgatcttatccacatgtcccttttatccacaggatcaacaacagcagatgtctgacctcagctgagacctctgaaagagctcccctcaaaggttcattcagtaatgcaaccttgccatttgagctcattccaaaggtgaccattcttctgctttgctattgggttttttcagaattggaataatgtgttctattttgatggcaaaatccatcttttaccactgcagcatctttttccatcgtagtgagctattccatagatgctctgattccctcctgtttctcctttctggaggccttgtggagatttggacattcttatccactccctacactgactgctttcctttcccatcacatggggggtgagcattgcttgtggtgttttattcattctctttcttactcctctctcagttccagacttgtcctttcttcacctaatcctctagattttgtatgctcagactccctagtaggagacataataccaggcccagtctctaattcatttttggtctctctagttttctcttttgtcttcatttttgtgttggccttatgtgtctgctttttcacattcttttgtcatccctttgagttccattcccatcattaaggacttccttggtcactaattcttccctaggtggacacttcttattcttccctggtctcttgttttccttactatttgtcactctctctacatattcacctatttatttatgtatttatttattagcttatggccctttatttacccattgaccaacctaaacagttgtcgacgtttgttgtttcattttgtccacctcttttgttgttggaatatatatttttaattatactttaagttctgggttacatgtgcacaacgtgcagttttgttacataggtgtacatgtgtcgtgttggtgtgctgcacccatgaacttgtcatttacatgatatttattttctatcgtctgttcctttaagatgtaagtcccatgggtatagagatttgtcatctttcctcatatatatatatatatatatatatatatgaattggaattggagatatatatatatatatatatatatacacacacacacacatacatacatacctgggaacaagagcagcacctgacaaatagtaagtccttaaaaactctttggaatcaacttgtggtagtggtggagcagtatctctattttcaactactgcaatgatcttcctttgaaacaaacctgatagcgcttaaagtgctttatgatctgtctagtttctcccctcaaaggtttgaataatccataatggcttcatatgacttttccagtgttcatgaaatggtttcctaattgctgttgctacaggcctcccatctgctcttatattatgatgcttctcaatgctttcttgaagatgagttccttctagggaggtcactcaagttcactgctaagaagttttactgttattaatacaagtgaagagcatttggtatacatgtagctcatttttcctttcatctaattctgatttggtggtaaagacctcaagatagctctcaggtagatccctgtatttcttttttcttccttttttctttttttttttttctgttttttttttttttgagacagagtctcgctctgtcacccaggccggagagcaatgatgcaatctcggctcactgcaacctttgcctcctgggttcaggtcattctcctgcttcagcctcccaagtaggtgggactacaggcatgagtcaccaagcctggttaattttttttgtatttttagtagagatgggttttcaccatgttggccaggcaggtctcgagctgctaacctcaggtgatccacccacctcggcctctcaaagtgctgggattacgggcgtgagccaccgtgcccggcctttatttcttgatttcttgaaaatatgctcttttctctttgtaaaggtaaaaccatttcctgagacataatcatttatgacatttcaatccccctatatttaactcttgaatttttttcatattatctgcaaactttatttctaagatgaatgaagcttaaaacattccattgttgaatttatggttttaactttgtgatagtctccttcaatattccttaagcctaggttcaaataagagccatttccagtgcagtatgcctctctcctcaccgcttgattatctgttgattaattaaatcaaccatccttttatggatcaattcagtcttagtctgtaccttggaaatcttatgccacagttacagcctattcagttaccaaatcagagtcaatttgaaactatattgtagaaagtggctcttaacagtataaacatggcacatgagtccaagagattagctcttggtatgtctcatcttcactctttttggaattgtatgccctttgaagtgtggcaagaggaaggaatttcaaatagctaaagtattagcctctattgttgttaaacgctgacaatataaaggctaaaatctcacccactcattttacagcctacatggatcttaactgcctttgcagatggaagcctcagccagttgatgtcaagaaacactacaaggaaaaaaaaattcaccccttgagtcctggaaagcctgtatcaggtgagccttaactgaaacgaaaagactccctttcccttcatacagtcgaatccctatctcacttattcctgcgtaggtcaagcctgcacctccatcagtcaaagtcagctacaaaagtctgtgtgagatgtatttactgagccctgtgctacttttaaaatagctgctaaacaccatagacatccactgcagtaagctgctatgatcctaaaagtcaagaactggagccacacttgaagcatcaatttatccacatgacactttgtttcatacaacatcaacccattgctggctctttcaatgttccaagccaacataccagtatatttaaattttaaggtcccaggacataattaatatgtttttccttcctccagtgttatgtacaaattgaagacagtaaacacataaattgccaggtgaatattaaaacggcagctttattattggaacagctaaattggaggaaagaatctaattgtgtgctcattgtggcacttttaaattctgtcctttgttaattaaatttacctaccccaagtgatagactgccttgctgagaacagagatcgtctcagtaaatgcactgtaataagagacagaaagtttgtaccttagagagcctcattctaaaaaatgaggaagtccaacacacacacatactctaatcctaaccaacagtctggtaagagagcatgtccaaagggtcgaggtgttcccatactctcctctctttaggcttagccatggggctatttttgtgagcaaaactgagacaattcatatcgccatgaagtttaaagtctagtggggagaaatagatactaatttttttaaattacggtaataataaagcataagtaggtaagagaagtttttgagaaaatattatttaagatattttaaggatgaataggaagagatgttctttttttaaaaaattttattattattatactttaagttttagggtacatgtgcacaacgt

SEQ ID NO: 21 - DNA, 5001 bp, Homo sapiens
ctaaatttattagtgttattgttatcatcattattattgagacagggtcttgctctgtcactcaggctgcagtgctgtggcaggaggacagctcactgcagcctcgacctcctaggctcatgtgatcttcccacctcagctgtctgagtagctgggagtacagacatgcaccaccatgcctggctaaaatttttgtatttttggtagagacaagggttttgccatgctgcctaggctgatctcgaactcatgaaatcaagctctctgcctgactccatctccaaaagtgctgggattacaggcatgagccaccaccacacccaacctaaattaattataaaatattaaacatgtcatttggttttaagaggtaagaggaatttccatggctaaataggatgtattttattatcattcacaattattgctttatttgaacttcaatttccacctgtgtcccaattaaactcaaaagaaagacccaagcctccctctcccgtctccctctccctctcccgtctccctctccctctcccgtctccctctccctctcccgtctccctctccctctcccgtctccctctccctctcccgtctccctctccctctcccgtctccctctccctctcccctctccctctcccgtctccctctccctctcccgtctccctctccctctcccgtctccctctccctctcccgtctccctctccctctcatgccgagccaaagctggacggtactgctgccatctcggctcactgcaacctccctgcctgattctcctgcctcagcctgccgagtgcctgcgattgcaggcgcgcgccgccacgcctgactggttttcgtttttttttggtggagatggggtttcgctgtgttggccgggctggtctccagctcctaaccgcgagtgatccgccagcctcggcctcccgaggtgccgggattgcagatggagtctcgttcactcagtgctcaatggtgcccaggctggagtgcagtggcgtgatctcggctcgctacaaccacctcccagccgcctgccttggcctcccaaggagccgagattgcagcctctgcccggccgccaccccgtctgggaagtgaggagcgtctctgcttggccacccatcgtctgggatatgaggagcccctctgcctggctgcccagtgtggaaagtggggagcgtctctgcccggccgccatcccatctaggaagcgagaagcgcctcttccccgccgccatcccatctaggaagtgaggagcgtctctgcccggccgcccatcgtctgagatgtggggagcacctctgccccaccgccctgtctgggatgtgaggagcgcctctgctgggccgcggccctgtctgggaggtgaggagtgtctctgcccggccgctccgtctgagaagtgaggaaaccctctgcctggcaaccgccccgtctgagaagtgaggagcccctccgtctggcaaccaccccgtctgggaagtgaggagcgtctccgcccggcagccaccccgtccgggagggaggtggggggggtcagccccccgcccggccagccgccccgtccgggaggtgaggggctcctctgcccggccgcccctactgggaagtgaggagcccctctgcccggccagccgccccgtccgggagggaggcgggggggggggggtcggccagccgccccggccgggaggtgaggggctcctctgcccggccgcccctactgggaagtgaggagcccctctgcccggccagtcgccccgtccaggagggaggtgggggggtcaaccccccgcccggccagccgcccagtccgggagggaggtggggggtcagccccccgcccggccagccgccccgtccgggaggggggagggggggtcagccccctgcccggccagccgccccgtccgggagggaggtggggggggtcagccccccgcccggccagccgccccgtccgggagggaggtggggggatcagccccctgcctggccagccgccccgtccgggaggtgaggggcgcctctgcccggccgcccctactgggaagtgaggacccctctgcccggccagccgccccgtccgggagggaggtgggggggtcagccccccgcccggccagccgccccgtccgggagggaggtggggggatcagccccctgcctggccagccgccccgtccgggaggtgaggggcgcctctgcccggccgcccctactgggaagtgaggacccctctgcccggccagccgccccgtccgggagggaggtggggggaacagtcccccgcccggccagccgccctatccaggaggtgaggggcgcctctgcccggccgcccctactgggaagtgaggagcccctctgcctggccagccgccccgtccgggagggcggtgggggggtcagcccccctcccggccagccgccccatctgggaggtgaggggcacttctgccgggccgcccctactgggaagtgaggagcccctctgcccggccacgaccccgtctgggaggtgtgcccagcggctcattggggatgggccatgatgacaatggcggttttgtggaatagaagggcgggaagggtggggaaaaaattgagaaatcggatggttgcggggtctgtgtggatagaagtagacatgggagacttttcattttgttctgtactaagaaaaattcttctgccttgggatcctgttgatctgtgaccttatccccaaccctgtgctctctgaaacatgtgctgtgtccactcagggttagatggattgagggcggtgcaagatgtgctttgttaaacagatgcttgaaggcagcatgctcgttaagagtcatcaccactccctaatcttaagtacccagggacacaaacactgcggaaggccgcagggtcctctgcctaggaaaaccagagacctttgttcacttgtttatctgctgaccttccctccactattgtcctatgaccctgccaaatccccctctgcgagaaacacccaagaatgatcaataaaaataaaaaataaaataaaaaaaaaaaaaaaaaaaaaaaaaaaaaaaagaaagacccaagccttgctaggctgattctatcatcccccccatgatagacgtgtaaccttggtcattcacctgaccccagttattcaaccaacaataatgtaagtcctgccttgaagggatttttgcatatataattaaggtcctaaatcaattgactttaagacagggattatccctggtcgggctgtcctcatctggcgagcccctgaaaggactgggttcttcctgatcagagagattcacagtgtgagagggattcagtgtgagggggttcctccaatgtggattctaaaaatgaaggggctgtgtggcaaagaatgctggtgggcaccaggaattgagagcagcctctctctaccttgacagtaggcaaggaacaggaaccttagtcctacaactggcagaaactgaattatgtcgcctctgtataagcctgaaggaggccctcaaaatgaaaacacagttttgggaaaccctaaacagagaaccctccaatcatgctcagatttctgactaaggaactgtaaataaataaataagtgttgtttggtcaaccatggtagctcatgcctgtaatcctaaggtttgtgggaatgacacaggaggattacttgcagccaggagtgagactagcctgggcaatttgaggagaccttcctctctacaaaaaggaattttttttttttttaatttacctgagcacggtggtacttgcctgtagtcccaggtactccagacactgaggcagggggacctctagaggccaggagtttgaggttgcagggaaccatgatcatgccactgcacttcaccgtggataacagagggagaccatgtctctaaaaataaataaataaatacaataaatgggtgttgtttaaagccagtgtttgtggtaatttgttatgcagtcatacaaaagtcatacacagactcaacagacacatggaatgaatttataaattgataagcacactacatgagtaaaataaaatatttcctttttccagtatttttcattttataatattccatgatgcgattaaatttttatacaatcatatttcattcaactagacaacaaaaattaatttagtgcctatgctgaaccaggtatgccctcatatgctcaagtgcctgacattctagaagcttcacaagaccgaagtggagccactggagtgttttaggtgaagaaacgacacactttgactcacagtagcaggaccactgtggagagaacactcaggtggcaggtaatggaacagtgctagagccactattcaggagtgacagagtggtggggactaagggaagaggagggcctgagggatgagagggacggagggaagggctggagaagcaggaggtgaggagaaggagcagagggacagaatttgaaagcagcagaattcttagctttaaacacattgttttataaatttttaatacatccatctacagagcctagcagggtgttccttgcatttggcctttaacaccttatgtgggactgcctaaaaattaattgctttttctgctttttttcaggtttaaaaaaatactaagtgttccaataaaacatgcacaccacttagatgcggatacttcctaaaaacaggaagtgcatgagcactggtgaggggcattgtgactgcgttgaacacttgcaactttgaggtgaatgaatgtattggctcctggttgcaatatacaatcacacgttgtgctactttgtattgtcaggagatgtcctggactcccacagaaactcagggctatggaatgaaggtaattttagaatacaacaagagtcacagatacatagtctgggaaagcaaaacttaggagctctgagagttgtacaactgtaatgcatttagacacatttatatatcaaggggccaaagtaac

SEQ ID NO: 22 - DNA, 5001 bp, Homo sapiens
ataatatataaaatatatatgtaaaatataatatataaaatatatattatatgtaaaatatatataaaatatatattatatgtaaaatataatatataatatatattatatgtaaaatataatatataatatatattatatgtaaaatataatatataatatatattatatgtaaaatataatatatattatatataatatataatatatattatatataatatataatatatattatatgtaaaatataatatatattatatataatatataatatataatatatattatatgtaaaatatataatatatattatatattatatattacatgtaaaatattatatataaaatatatattacatgtaaaatattatatataaaatatatattatatgtaaaatattatatataaaatatatattatatgtaaaatattatatataaaatatatattatatgtaaaatattatatataaaatatatattatatgtaaaatatattatatgtaaaatatatattatatgtaaaatatattatatgtaaaatatatattatatgtaaaatatatattatgtaaaatatatattatatataaaatatatattatgtaaaatatatattgtatgtaaaatatatattacatataatatgtgtaatatataaatatatattacatataaaatgtataataaaatatataatatataaaatgtacaatatatataaaatatataatatataaaatgtacaatatataaaatgtactatatataaaatatataatatatataaaatatataatatataaaatgtataataaataaaatgtataagatatataaaatgtataatatataaaatgtataatatataaaatatataaaatatatataaaatgtaaaatataaaatatataatatataatatataatatatattataaaatataaaatataaaatataatataatatattataggtactttatatataatatataatttattatattatatactttatatataatatattatatattatatataaagtatataatataataaattatatattatatataaagtatatacattatatataaagtatatatgatatattatatataaagtatatatattatatataaagtatatattatatataatatatataaaaatatacaatacatatataatataaaatatatgtgtgtgtgtatatatgtatacatttttttctgagacagagtctcactctgtttcccaggctagagtggagtggcttgatctctgctgactgcaacctcctcctcctgggttcaagttattctcatgcctcagcctcccagtagctgggattacatgtgcgagccatcacacctggctaatttttgtattttttgtagagacggggtttcatcatgttgggcaggctggtcacaactcctgaccccacgttatctgcctgcctcggcctcccaaagtgctgggattacaggcgtgagccactgtgcctggcctgtttatgaatatattctcatcagcacctgtcaactgctgaaactatggaaaatgggctaggagctctgctcaacactgcggctatggcaataagaggtatcatggcagtcctcacaaatctccctcttgttgaatggggatctgatgagagactaacatttagaagaggctctgtccgttttgacacaggaggaacttttagtatttcacgtgggaccccaaggccacaatggcatggaaatgactgtcagcattcacctaactgctctgaggaaatgtgcccgtggtgacataattagtaaagtgagacacaggatcttgacctcgaactcatgtcctatgatcctcccctcactggcatcccactcataagtactggggccatgcaggatgttaccagatgttccatgggtgccgttatgtaacccatgactttgaccttcactcaacactgtaggacctgagacttacattcccaggtagtgaaagactctcagaaggcaggagtatcagaggatgtgctgaaacctacatatcttcagccattgcttttcctgttcattagctaccaaatataaatggtttaatatttttgtgctgaaagacacatatcttatgtcattgcttttcctgtctcattagttaccaaacaaatataaatgttttaacatttttgctttcttttaagccatattgattattacactgcttcttctgggtacttaaactatattactgaatatctcccatcatccttgattttgagattattgtctttccattttttgttttttggatgccaataattttttactcatcgttacttttctgtttttgacacagagtcttgctatgttgtccagacggaagtacagtggcacaatgacagctcactgaagcctcgaccttctgggcttaagcaatcccttcaccccagccacccaagtagttgtgactacaggcgcatgccgtcacacccagctaattttttaaatgttttgtagagacaaagcctcactatgttgcccaggctggtctcaaactcctgagctcaagtgatcctttctccttcgcatttcaaagtgttaggattacaggcgtgagccaccatgcccggctttattttcacttttcttatgaaaaagtgtgtagtgtcatccaagattaatatatccctacattaagatcctattattttcaacatgtatgtgattttgaaaatattcttttattttctactattattttttctattctcctatcacagttggatgtttagaagccagtatctgtagaatattttaagttttatagactaattgatctcctcaaacactgataaagatccctccctccttcttaaaaaatacccactggaaaccattgaaatctttcatattcaattcaaaatgtcaagtctattaaaatttaattcttattgaaatatttgatttgccatttttcagaagtattcatacttcttgactagaactgctcatttgcaatctagagacctattctgagcatcaggtccttttgataaaggatatattgaccatcacaatggacgcaaatgattcaatgcctgaatcctatatgtagtcccgaccttccctcttgcacagagactctttttcaagccacgtagttgcctgaaccttcatttctgatgcaggtgtgcacagtggtagtcatagaggaggaaactgtgaagcagcccaaatcccactggtgtcccccactccagccacggcggccccattcctcctgtctggaccctgctaggtgaggacagcctcaggctcctgtgaagggctcatgttcctgaccatcccagagctctcaccactgccctccatggcccctccagggaaacacctctccaaattttgccatttcatggcctacatcatgactattttaagcaagactaaaggctgataatgcaaatatggaaacatatttgcattttttttttttttttgagacagagcctcgttgtgtcacccaggctggagtgcagtggcgcgatctcagctcactgcaagctcagcctcctgggttcacgctgttctcctgcctcggcctcttgagtaactgagactacaggtgcccgccaccaagcctggctaattttttttttcttttgtatttttagtagagacagggttacaccgtgttagccaggatggtcttgatctactgacctcatgatctgcccgcctcagcctcccaaagtgctgggattacaggcgggagccaccacgcccggcccatatttgcattttaaaaagagctttagttaagagtgaccgaagagagaatgtgaagccccctggcagttgctaggatggcatgtggggtggacaggccttgtaaggtcccctaaattcccccgtgtagacagtgacacactcccatatatgcagtatggcgctcaatgagggagtgggtgggctcattttatgcaaaagggatgtgataacagctaagccatcccatggccgacacttggaggtgttctcttgaagggtgggtcagcctcttcctctctgctggccagtttcttgtgtcaaagagccatggattctctacacagtcggctggagggagctatgaagctagtggctcggaatggggaaagagtaaatgctccaaatcaaaatgaaacgtatttgctgattacaaccgatgagttgctccagtcggctcgatgtcaaaagtagaaagaaataaatttttaaaatgtaatcttctattgaagtataatgtatatacagaaacatttgtaaaccatgtttcctgttaataaaatttcaaaatggaaactcactcatataaccaggaactgaatcaagaaataaaatgctttaagcgccccagaaacctttcttagtggcccctcccaatcaccatcccctttcatcccagagccgaccactgtcctgattttcaacactaaggatttattttttcttccttttgaaatcgcacagtacgaattattttgtgtttgaattttctcatgcaacactgagtgagatttactttatagtaggatcagctactaatttgcaggggccattacgaaatgaaaatgcaaggccattgttgaaaaatcaagaattccaagatagtgacagcagcacattaaaccaagcccagggtccttttagtgcagggccctctgcaactcaaaggtggcagaccccaaagccagccttgtagagaatcccaaagcatgactatactatatttgtccatcttactactgatgaacatatttgtgagatttccattctttggtgctcctacaaacattcttgcacctctttggtgaagatatggatgcatttctaataggtatatagttgtgaatggaattgaaaggtcctaggcagacagatgttcggctttggtagatgcaagcacaaatttgttgtatcaatttacacttctacagtcagtctttgag

SEQ ID NO: 23 - DNA, 5001 bp, Homo sapiens
ggttatagtgtttcaccaatagctgcattcaggtaataggattctgatattttccgtgacttggattacagtgtgaggtaggaaatagccccaaccctttgttttttacatatgttgtacagatgctgttttaatgcatgtatcgtgctgaatttaaatacatcgagaacttcacatcagtatttgagctcaaattccgtatagttttgagagccaaactttataaactttgaaattacctaatatttatcatttaatcccttaaaatccaaatcagcctttgatttatgatatctgtgactttcacaacgtctaaaatgtgtagagacttcgcaagctgctcaaattattccctaaaacacagcaagtcttcagtgtgaatccagttgacctttggggtctgtctcgggtggagtctgcatggaggctgcggggccgcacatctgttgagtaccgtgtcctttcctcttgggtctgtacagtcagcaaacattgcgagtccactgtattgctgactgtagatgagaattgatggtgaatgtttttgaaatgcccatccttgagagagagctccatgaatttaatgcccatctttgagagagctccaggaatttagatttacatttgcttgagatgtttccttgaatgagcttaacctgcagaaactcaaccccaccgagtcgtgcagtcactgtcatgtggagcttccagatggccccactgaacacgtgcagtccatcctttcatggtctctactacagtgtaaacataagggtcacttccacttcgtcactaactaaatcatccgagtatttataccagtgcagggcaactgagatctgggcaaaagaccttccatttgtgcaaggatatttgagattgcttttaacttagaaggtgctgcagttgattggagtaaaccacaaacagggaacccaaaaacaatgggaggggttttgtaaacttacgtagactcagactgaagcctggtgctttgggccattgccgctgccctaggcgactctggccttggggtgcagtcctgtgtgatgcatgtgctgtggctttccagttagcttctccaccctggttaagagtctgctttcaggtcagagactgcagccctgaggtcgtgtgtgtgtagagagctcaatgcctgtcctgggggctccccgtgggctgggggcctacagccctgacttggcggatctgtctgcagctggccgtgcacattagggctgcttgggaagagtgcagggtctgggcttctgagtctttgggatgagaggccttcctcacatgagccatggtgagggtgctcccaagaggaaggtgagcgtgtgcagagcacttaggtccaaatgggtgggtagagcttatgttccccctccatccctccctcactctctctgctgcttgaaatagcaaatctgagatctccttgacaaggtgatatttaagcaaaggcctgatgagagggtgggagctgatgccagatgcctgtgggccagatttgggggcagaggggccagtcggagctgtcacgaggtcaggtgggctagacttggagggccctgcagctctgtgtgaatctggagtccaccccgaccgagaagcttgacccaggtgattgcagcaggtggtgagacctcattgaccacatcccgcagaaatgctcaaggtctgcagaccgaccacatccagctgatgatggcacacagcttggtctagatctagggtttagtaatgtcggaaatattggtgttgactgatgtggagtaaagctactgggtgaagcgggcatcccagcctcatccatccacaccttcccaccctggagatccgtgaccagcctggccgtaaatgccaggccaaccttgatgacatgaaagctgttggcccctctaggtgaggattcagcagaacccacctgacccagtaaggcaggctggcaggggagggaagagccacagcctctctttcgggcagactgactgggcagggcgtgctgtcatgtcccctactcctagcctcgtggtaagaaaggagaccttctgcttaccctctttggcttggggttgccccctttcttccccctgggcctcaggaaggtggagaggggatagtcaagagagtccacagtccagatgggaggatgggaaagaggctacgggttctgcagacaggtgtgcctgcctgtcacagaggaaactgtaaagagtgtgccatcaggcctcccactgatgggactcatcgccacaggcaacgcactgaaacctttccatcaggcatctggcctggataaccttgagtgtcctttctagctctggaattctgtgactttctattctatttattgaatggtgggtgagacattagtaaagtgtaactcttaggagtcaataaggaaggtagaactatgtcataactcttaggagtgagtgggaaaggtagaactatgtcataactcttaggagtgagtggggaaggtagaactatgtcataactcttaggagtgagtgagaaaggtagaactatgtcataagccttaggagtgagtggggaaggtagaactatgtcataactcttaggagtgagtggggaaggtagaactatgtcataactcttaggagtgagtgagaaaggtagaactatgtcataagccttaggagtgagtggggaaggtagaactatgtcttaactcttcggagtgagtgggaaaggtagaactatgtcataactcttaggagtgagtggggaaggtagaactatgtcataactcttaggagtgagtggggaaggtagaactatgtcataactcttaggagtgagtgagaaaggtagaactacgtcataagccttaggagtgagtggggaaggtagaactatgtcataactcttaggagtgagtggggaaggtagaactatgtcataactcttagaagtgagtgggaaaggtagaactatgtcataacttaggagtgagtgggaaaggtagaactatgtcataacccttaggagtgagtgagaaaggtagaactatgtcataactcttaggagtgagtgggaaaggtagaactatgtcataactcttaggagtgagtgggaaaggtagaactatgtcataactcttaggagtgagtggggaaggtagaactatgtcataactcttaggagtgagtggggaaggtagaactatgtcataactcttaggagtgagtgagaaaggtagaactatgtcataacttaggagtgagtggggaaggtagaactatgtcataactcttagaagtgagtgggaaaggtagaactatgtcataactcttaggagtgagtgagaaaggtagaactatgtcataactcttagtagtgagtggggaaggtagaactatgtcataactcttaggagtgagtgagaaaggtagaactatgtcataacccttaggagtgagtggggaaggtagaactatgtcataactcttaggagtgagtgagaaaggtagaactatgtcataactcttaggagtgagtggggaaggtagaactatgtcataactcttaggagtgagtgagaaaggtagaactatgtcataactcttaggagtgagtggggaaggtagaactatgtcataacccttaggagtgagtgagaaaggtagaactatgtcataacccttaggagtgagtgaggaaggtagaactatgtcataagccttaggagtgagtggggaaggtagaactatgtcataacttaggagtgagtggggaaggtagaactatgtcataactcttagaagtgagtgggaaaggtagaactatgtcataactcttaggagtgagtgaggaaggtagaactatgtcataacccttaggagtgagtgaggaaggtagaactatgtcataagccttaggagtgagtggggaaggtagaactatgtcataacttaggagtgagtggggaaggtagaactatgtcataactcttagaagtgagtgggaaaggtagaactatgtcataactcttaggagtgagtggggaaggtagaactatgtcataactcttaggagtgagtgaggaaggtagaactatgtcataactcttaggagtgagtggggaaggtagaactatgtcataactcttaggagtgagtggggaaggtagaactatgtcataagccttaggagtgagtgagaaaggtagaactatgtcataacccttaggagtgagtggggaaggtagaactatgtcataacccttaggagtgagtgaggaaggtagaactatgtcataacccttaggagtgagtggggaaggtagaactatgtcataactcttaggagtgagtggggaaggtagaactatgtcataagccttaggagtgagtggggaaggtagaactatgtcatttacagatgtatcatcaagaacatgccccatcctgccctgatctcagaaggcaggtggagtgggacctgtttggtactgactcctctgggaatgataagagtcacaggcttttctttatttctttcattttcttccagaggcggcctgctgtggtagcttcagacaggctgactttgtctcaagcgctggttctgccccttcccagtggcctgcccttaggggatccctggaccactgggctgctccctggcttctgatcagtgtggcctgaccggctgcagggacggcacctccacagcaccagcatccaggcagaggggatcgtggccacttcttccaaaaccaagtttttcctttcctggcattaattctaacatttctcttaatatttatgtcaaactattttgttaaagagttttttctgttaaaaataaagcaatgtccgtcctacctcagtatcgctgttcttgcagaatgaagtgaagcaggaacatcaccaaagcctgcaggtgtggcctggcgggagcagagccatctgcttctcccagggctcccccagagcatggcccccaggtcaagtgccaggaaggatg

SEQ ID NO: 24 - DNA, 5001 bp, Homo sapiens
tttactgtctttcagcttcaaatacatacttcatcgcctgcttggtgaaaatggagctgggccctaaattgtttctcctttaaagcaggtatgacgttaagctttgtaagtagagggcactggagggaccctgcaggaggaaagtgcttctcttcctgttctgcactttcttctgttttcttcttgttcctgccatgtggctgccagcacactcagtgttgctcacccccagccaacttcacttgcaatgccatgggtggatccccgtgagtcttgcagatgctccactggtcagcatccagcctcagcctgccccagagaggtgtttcctgcttgccagtcctggccaggctccctacctgccaccttcaacccctctacacctgcaggagtgattgcccattgactgtggaccagctctggctacgggaaaaccagagaacctctccatcatccatactgcaccaaacagcatctctgcaaccacaccttttccaagatttgagccccagccttggggaggaggccatctttcacattttctccttccttgggaactctctgtcagcccagagtattcttttgcattatctttagccctgtacagataattccattatagtaaataatcctttatattaaacgttccttgcccaaatgactgtgcagtttctgtctgctgattgattgcgccctgatgcagaaaggtaaagtaacttgacatgttgcacagctggcccacacaatcacacagctgagactgcacaaggacagcttcctctcaaatgtgttggaaataagagcttggagtcgcaaagaaaatgagcactcaaggctgggcgcggtggctcacacctgtaatcccagcactttgggagaccaaggtgggcagatcacgaggtcaggagatctagagcatcctggcaaatatggtgagaccccgtctctactaaaaaaaatacaaaaaattagccgggcaagatggcgggcacctgtagtcccagttactcgggaggctgaggcaggagaatggcgtgaacccaggaggcggagcttgcagtgacctgagattgcaccactgcactccagcctgggcaacagagcaagactctgtctgaaaaaaaaaaaaaagaaaagaaagaaaaaaaaaaaaagaaaatgagcactcaaatactaaaaacacacacaaaaaattagccagggctggtggtagacacctgtaatcccagctactcaggaggctgaggcaggagaatcgcttgaacctgggaggcagaggttgcagtgggccaagactgtgttactgcactccagcctgggcaacaagaacaaaactccatctcaaaatacaaacaaaaaaaaacttccactggcttttttttgagtgctcacaaatttgccttctcagcaaggcaaatttacttctgcagaagagtgccgctctctcttctggccactgggagagcacaccgaacaaagcagggcaggggtgtttatccctaaagcagtcacgccctgctactgtgtccagtccccattggctggagtcgcaccacaccatctaagccgatccccattggctacttcaaatggatcaggggcggctacagtggccaaataaggaacagatgtgggttttacaggttgggctgcagattgggaacagatgtgggttttacaggttgggctgcagattgggaacagatgtgggttttacaggttgggctgcagattgggaacagatgtgggttttacagattgggctgcagattgggaacagatgtgggttacagattgggttatagattgggagtggctggaaggttgtttgctgtaaagtggaacctttgaagaggaactcactgtatctaacaaatgtaaatccaattatgtcgagtctacttcaaaacttcctgccaggtgtggtggctcacacctgtaatcccaggaagtgggcacgttttccatggccagagcaggaggaggagaggagtggggaggtgccacatacttttttttttttaattctccaatttaaaacttttagttaaaaagtaaactttaatgttgaaaatgcaaacttggggcaggtagaaagattacacacaaggctatcacttcacatttggagggttgcacagcagccgggcaaaggcgctcctcacttcctagacagtcgggggacccgggcagagacgctcctcacttcccagacagtgggggtacccgggcagaggtgcccctcacttcccagacgatgccgaggctggggtgccacatacttttaacagaccagatctcaagagaactcactatcaccagaagggcaccaagtgggaaatccgcccacatgatccaatcacctcccaccagaccccacctccagcattgaggatgacagttgacatgggatttgggtggggacacagacccaaaccatatcactcctgaagagctaggactacaggaatgctatacctggctaattgtttttctttttttcgtttgtttgtgtttttttttttttagatggagtctcactctgttgccaaggctggagtgcagtggtgtgatctcagctgactgcaacctcccaggctggaatgcagtggtacaatctttgcttactgcaacctctgcctcccgtgttcaagagattctcctgtctcagtttcccgagtagctgggactacaggcgcctgccaccacgcccagctaattttttatttttagtagagacagggtttcaccatattggccaggctggtcttgaactcctgtcctcaggtgatccacctgcctcagcctcccaaagcgctgggattacaggagtgagccactgcgcctggccacacctggctaattttaaaaaaatttcttgtagaaatgaagtctcactatgttgaccaggcaagtgtcaaactaactcctggcttcaaatgatcctcctgcctcagtctcctaaagcactagtattaaagctgtgagccatcatggttagcctgtttttatatctgggaactgttgctgtacaaaaatcaaatatggggttggagtggttcacatctataatcccagcacttcagaaggctgaggtgggatgattgcttgagtctaggagtttgataccagcctggacaacaggaagtctaggctgcagtgagctgtgtcgggctgctgcaccccagcctgggcaacagagcaagcccttgcctcaaaaaaagaaatcaaatatgaagactaagagttttaggatttggtgttaagaggttttgttttgcgttgttttgaatttttgtgggcacatagtaggcgtacgtatttatggggtacatgtttttgtttcttttttttttttttttgagacagagtctcactctgtcacccaggccggagtgcagtggcgtgatttcagtccactgcaagctccgcctctcaggttcaagtgattctcctgcctcagcccccgagtagctgggactacagacgagcaccgccacacttggctaatttttgcatttttagtacagacggggtttcatcatgttggccaggctggtctcgaactccgggcctcaagtgatccacctgcctcagcctcccatggggtatacgttttgatacaggcgtgcaaagtgtaatagtcacatcatggatagtggggtatccatcccctcaagcatttatcctttgcgttacaaacaatccgattatactctgttactttaaaatgtacaattaaattattattgaatatagtcaccctgttgtgctatcaaatactaggtcttattctttctaatttttttgtacccattagttaagggtttttttttttttgagacagagtttcactcttgtcactcaggctggagtgcagtggtgagatctcggctcactgcaacctctgcctcctgggttgaagcgattctcctgcctcagcctcctgagtagctgtgattacaggtgcacgccaccatgcccgacgaatttttgtatttttagtagagacaggatttcaccatgttggccagggtggtcttgaactcctgacctcaggtgatccacccacctcggcctcctgaactgctgggattatgagacttacggtttaccaaaggggtgcgatgggccttctgtgtggtgtccgcatcctctcctagctggtttcgggagagtgccggccctctggggcctctctccctggctcgccctttagaaggggttcacatagttagaaccttagcagtaaaggtaacctgtgccttgcgcagggcgggggacctggtggggaccccagaggcaatggtgtcagccccggttatggactggcgtcacttgcggcagccaggtcccacatgcacccaccctaatttaattagaccaggcagctaggcaggaacacgtttatttatttttaattaagctttttgtgataattttagatttgcatgcagctgtaaggtgttttacagagagatgctgggcaccctttacctccctcagtggtagcacctggaaccctgcagtgcacacagctggggtattgatgttcacagagtcaggatatggtcctcacccttccacagccacacccactccctccctccaaccctccttcagggctggcaaccattcatctgttctgtccatttctgtaattcttttttcttttcttgtcctttccttttcttttctttttttctccttccttcctcccttccttccttccttccctcccctctctctttctctctttctttctttttcttttctttctttttttttgacagtcttgttctgttgcccaggctggagtgcagtggcgcgatcttagctcactgcaacctccacctttcaggttcaagagattttcccaagcctcccaagtagctgggattacaggcatgcaccatgcctggctaatttttgtattcttagtagagacgaggtttcaccatgttggccaggctggtctggaactcctgacctcaggtgatc

SEQ ID NO: 25 - DNA, 5001 bp, Homo sapiens
gtgtgagctatgttccctctcttcctattcatatggctacaagtgaaaaactctgagatggcagaattaaaagatggaaacctgcagaatctctgaatcactgttggacaagggcccccaaagagaacccctaccctgcaccagactatgctatgggtgtcaacccactgagagttcagggtttattcgtctcagcagcagtctattgttacactgactaacatcctgaggtttgagaggtctagcatattgttaactgaagttagatttcaattacactgagaaccttatctatttaaaaataaaaactctcctaaaaaaaaaatccacattccttttaaccacatgtggcaaatttgcaaaaaaaaaaaaaaaaaaaaaaaaaaaaactggccacatattaggccataaataagtctcaacaaaatccactatacgattgacagtgtccagagcacattttcctgaccataatgccacaaaattagaagtcaacagcaagaagatagctaaacgcaagcatatatttggaaaattaaaaatatcctttcatgagttaaatgaaaaatcataatagaaattactaaacatttacaactgaatgaaaacacaactttatatatatatgtatatatataatgtgtgtatatatatatatatatatatatatatatatatttttttttttttttttgtgagtcttccaaatttgttcttcttttacaaggttatttgggaaattctgggtctcctgcaattcctcttacagttttatgctgtgtgtcaatttctgtggctgggtctatgagaacttattgtagttctcatagaccagggtttgcatgttgctgtctagagccctgatctgctgcaccatgtccgtctcactatccatcagctgggccagagggcactctctaggaagcttgtctaggtaaacttccgggtcgaagtgcaccccgttcagatcagtggggtccaggggttcggtccccgcggggagtcccaccgcctccacttccgagaggccgttgtaaaacttcagcatcctgtccgccttccaccgacgctccttgagcctccccctcgggcccttctggggagtccccaggtccacaccccgggctaggcccagtgacagctgccgccgccatagctccaactgcagcccacgggcgtaacttttatatttttaagttggatacatggagctacttggcttttgctttcatcacctcgttgaggaaagagctggttgcttatggtacccctgtttttactgcaacgtgtaatggatgagaacctccctgttgcagagagcaaaacactgaactaaattgtgctgtaacacagctctgtattgggggagtgggagtgatcatgcaaacgcttgcaaatttgcacagtgacagagacaatcgtttgggcagctgttcactatatgaaaaggcaattgaccaaaagtcagttactgagctatctcaatactttcattttattttaacttttggcagcagggtgcaattaaaggagagaaagaaaacaaagtgataagtgtaaaataatgtacacacatgtgtaaaagaaaatgacaagacaggatgactatttgtctcttggttagctccttgggctctatgtctccttcctcggagaacctcgttttcctttgcccagatttgttagggtggataatccaggcgcctgctcccccatgatggaagccaaagacgtccctggagcagcgtcccgctgcatcctttcctgcactgcccacatggacacaactcagccgattagtcttcctctcagaactttagtcttgagcaaagggattaaagggtgaagtgactgaaggtatgcccttccaaagtggtacgtgagctaatggctaaagtttgccaagcccatccaagcactttttttcgtaatttttatttatttatttttttgagacggagtcttgctctgttgcccaggcaggagtgcagtggcgtgatctcgattcactgcaacctctgtctcccggcttcaaaggagtctcctgtctcagcctccccagtagctgggatgacaggcgtatgccaccatgcctggctaatttttttgagtttttttggtatttttagtagaaacagggtttcaccatgttggccaggctggtctcgaaatcctgaccttgtgattcgcctgcctcagcatcccaaagggctgggattacacacgtgagccaacgcgcccagcttcaaagagttttaagcagagctcagaggtcttaaccacaggcacatcggaggagcatttttgaaacactttccatcttcctcaataggaatggaagccaaactccgaattgatgactcctttgaggaagttgagagctgtaaggaaagccaggaacaggggcaagggagagatgcgtcccgaatgatcctgtgcaaattctttctggaatccttgatgtgatctcagctgccctttctatacatgacacagtgattgtggcacccactggtctagctgtggtctacaaggaacccccaaagggaagggcacagtgagcaggggcatccgcctgagtgacgaggatttgagagggcaggttggttgcagggagaggacttgccaaatgacatgtgtctggacttagactgcctggttcaaattggacttcaccctttttgacttcgtgatctggtacaagctacgtgaaaatccgttgagctttttctagtctgtaaaatcatcatgaaatgtgcactaataactgggagactatgcagatgaaatgaaacaagctgcatagagcacagagctcagagcctggcctttaggaagccctcagtaagggttcatgatgccatggtgtctgtcgtcatcctctttatcctcatcatcaccttcataatctctttgttgttcttagggaatagctagaggggctgattccctgctatcatgggtgagatgtttatgagaaggacaaccagtgggggaggaaagcaaaattttgaataagatttctgagacccccagcacaaccaagaacataaactgcacagtctgctgagcagagagttgcatattggtctcctcacatctgcccaccgcactctcctgtttgtcctgaggatgaggaaacaaacaagtctcccgaacgtccctcagcactcacttgaaggggtggcctcctcctccacagctgtgggtatttccagtcgggtaggacgagagactgagaaaagaaataagatacagagacaaagtatggagaaacaacagtgggcctaggggaccggcgctcagcatacaaaggacctgcaccggcacaggcctctgagttcccttagtttttattgactattatttttattattttagcaaaaaggaatgtagtaggagcacagggtgataataaggagaaggtcagcaacgaacatgtgagaaatagaatctacttcataaggaagttcaaggaaaggtactatgactggatgtgtacgtaagccagatttatgtttctctccacccaaacatctcagtggagtaaagaataacaaggcagcattgctgtaaacatgtctcgcctctcaccatagggtggtttttctctcatctcagaattgaacaaatgtacaatcgtgttttataccgagacattcagttcccaggggcaggcaggaaacagcggccttcctctctctcaactgcaagaggctttcctctttgagtaatccacctcagcacagaccctttacggggggcgggctgggggatggtcaggtctttctcatcccacgaggccatatttcagactatcacatggggagaaaccttggacaataccctgctttcaagggcaggtctccctgcggctttccacagtgtattgtgcccctggtttattgatactagagaatggcgatgacttttacaaagtatactgcttggaaacatcttgttaacaaggcacgtcctgcataaccctagatcccttaaaccttgatttcatacaacacatgtttttgtgagcttcaggttggggcaaagtggctggggcaaagctacagattaacaacatctcagcaaagcaattgttgaaagtacaggtctttctcaaaatggagtctcttatgtctttcctttgtacatagacacagtaagagtctgatctctctttcttttccctacactcactgaactgcctctcccctctgctgggacatgaccacggagaacaggtccactgtcctccctgcgtggtgcaccatggaggctcagactccgtcctcaaggctggcaagaagacagggtgagacatgagcctcctgatacaggtgacggctgtggagaccacaggactgcaacctcacactgcagggctggaggcacagactgagtatttactatcctgtggcctggggggctcaggcacagagctcctcattagccaaagctgcccaagttccccaacctgtaaggatgtcctcacaataatgcaagaagaagaagagaaaagtgagtgtccatagaaactttggggctcctcctctaatcagaagaaagctggtgtgtattcttcgcttctttcttttctttttaaacatccaactgctttaattttcatcttttataatgggaaaatataccacgtataaatattaaaaattataaatatatattagttcatatagaatgaccagtataaacatttacaatttccactctttttcagtttacagattattgacattaagtacgttcacattatttagcaagcatcaccgccatcatctcaggaacagttttatctttcaaaatggaaattccacccattcaccaagctctccattcctttctctcacccacccctgggggccacctttctagtttgcaactctatgagtttaactactctagacacttgatagataagtggaatcataccgtgtttaatttttttgttttggagacagagtctttctctctcacccagtctgg

SEQ ID NO: 26 - DNA, 5001 bp, Homo sapiens
gagtgcagtggcgtgatctcggctcactgcaacctccacatcgtgggttcaagcgattcttgtgtctcagtctcccgagtagctgggattacaggcttgcaccactacgcccagctaatttttgtatttttaatagagacgagctttcaccatattggccaggctggtctcgaactcctgacctgaagtgatccgcctggctcagcctcccaaagtgctggtgttacaggtgcgagccactgagcctgggcctgtttatccttttgggatttatttatttcactgacgataatgtcttcaaggttcatccatgttgcggcctgcctcagaagtgcctgtctgttttttttgttgttgttgttttttgtttgttcgtttgactttgttttgttttgtgtttccatggagtctcactctgtcgcacaggctggagtacagtggcacaatctgggctcacctccgcttcccgggttccagtgattcttgtgccacatcctcccgagtagctgggactataggcacacgcctccatgctcatctcattttttgcattttcagtagggacagggtttccccaagatggccaggctggtcttgaattcctgacctcaggtgatccgcccacctcggtcttccaagacgctgcgattacaggcgtgagccaccgcaccggccagaagtgcctgccttttgaaagctgaatagtcttccattgtatgaaggaactgcagtgtgctttttcattcatctgtccacgaacccttgggttgcttccacattttggctcttgtgaataatgctgctatgaatatgggtgtacacaaatctgtcttccactcctggcttcttttttgtaggtacccacaaatgcaactgcggcaacatctgatcatcctgtttctaatttttccagtagacaccatactattttccccgttccttcacggttttacattccctctgatcagattcgagcattcctacttccctctagtctcaccaatcctgtttgtttatcatatccatcctaatgtgtggtgtcacattcttggtttgatttgcgcttccctatgatgagtgattttgaacatcattttagatgcttattggccactgctatatcttctttaggaacacgtctacttgagtcttctgaccattgttgatgggatgctttgggtttcttgttgtttagttctgcctgttctttatgtatgatggatatcagcctcttttcagatatacgctttgaaaatatttttcctaatccatgggttatcttttcactcagtttgccgtgattttgctgcacaaaagtgtctgtcatttcgatgtaatccaaggaatctaattttcttttgttgcctatgcttttggtgtcacatcccagagaacattgcccaatctgatgtcatgaaagcatggccaatgttttcctttaggcgaatgattcttttagcgcttggggtgaggtctttgatccagtttgtgttaatttttgcccctggtgtgacatagggtccaccttcaatcttctgcatgtggaaatcaagtttctccaacaccatttcttgaaaaggctgtttttccaccaatgagctttcttaccactcatgttaaaaatcatttgaacatacaggtgacaagttatttctgggctccaaaataaacaaacaacagcagacaacagataatgttacagcatgggctgggcgcgtcgctcaagcctgtaatcccagcactttgggaggccgaggtgggcggatcacctgatgtcaggagttgaagaccagcctgaccgacagggagaaacctccgtctctactacaggcgcatgcctgtaatcccagctactcgggaggtggaggcaggagaattgcttgaacccaggaggcagaggttgcggtgagccaacattgcaccatgacactccagcctgggcaacaagagcgaaactccatctcaaaacaaaaaacaaaaaacaaaaaaccagcatgatttcaagagcagaaagagaagagctgaaaaaccagcataatgagaaaattaggaagtttcttaccaaagcatctggaaatattcaagaaattcttgtgaactaaaattttcatactgtacaatcaaacactagaactcacttattccatctttctgtattttgggacccaattatccacttgtcttcattccccatcccaacccttttcttcctagcgtctgctaaccacctttatactttccaccttcctgagattccttttgtgtgtaggtgtgtgatggagtctctttatgttgcccaggttggagtacacaggcacaatccgggctcactgtaagctccgtctcccgagttcaagcgcttcttgggcctcagccctccaagtagctgagactagaggcacgcgtcaccacgcccggctaattgtttgttttttccgtagagacggggtttcaccatgttggccaagcgggtctcgaacccctggactcaattgatccgtgcgactcggcctcccagagtgctgggattacaggtctgagccaccacgcctggtcaaggtttccttttttcttcctacgtagaagtgaggacatgaaatatttgacattctgtgcctggcttatttcatttaatatacagacctgcaatcacatccattttgtctgcagcagagaggattttcttcctctttaggctgaataatacttcattgggtgtgtataccacagtttctttattgaaacaaatttctaaagagcaaatatttttaaagtctcagaatgtgaaacttcagggataccgtgcccattttattcttttctatttcccatcttatgtatatgcaagtgtataacaaagcagcaattgatgtgtgtataaatctataacttcaacaattgcaaaatgtaaatgctaagtggtggctgggcgcggtccctcatgcgtgtaatcccagtactttgggaggcggaagcggccggatcacctgaggtcaggagttcaagaccagcctgaccaaaatggagaaacattgtctctactaacaatacaacaacaacaacaacaaaaagatagccaggcatggtagcgcatgcctgtaatcccagctacttggaaggctgagacaggagaattgcttgaatacgggaggcagaggtttcagtgagccgagaccgtgccattgaactccagcctgggcaacaagagtgaaactctgactcaaaaaaaaaaaaaaaaaaaaaaaaaaaggacaggaaggaaatagaaaatgcgaaatggtaagaaaaaacagcataataaacatttgtatggcgttgatggacaatgcatttgaagataatatttgaagaaatcatattacaattaatttctgttcttactcattgcagcttgatgcctctaaaaacttcgtcattggaaccatctctggtgctttaaaagaaaaaaaaaaaatccacacactcacacaggtgcaaggaaatcagaatctcaggtattgagaaccagtcctcatcatgtgtaagctgcccaggtgatttgactcaaagccaagattgaggaacggcgacatggatatctacacagaacctgcctaaatagattctctagaagaagtttataaagaaattccacatgaactgtggaagaggatatgaatttgatgtacagtatgtcctcacttaacatctttgaaagtctcttggaaacttcaccttgaagcaaaattatgtacagtgaaaccacttatttttcatcaacagtataactacacgactttgaacaaccaatgctgttggaggaccttctgtacattgtttccataaagtcagttttcagggaattccaaaacgaagtgaggacttcgtgtatataaaatgatggttgtgattccacctggatgacatggttattgctcagagactaaaagaggccacctaggtatagaagattctgtcatgaggtttctgctaaaccaaggatcccagaatcgtcactcattccagataaaggcataacgaagaaagcaatattcacaaaggaaatgcggaaaggaataaaaaccatcaagccacaaaaagaatgtgactaaggggcaggatttgcagataaagagatttaatgtgattgccctttctcacccacacaagaaaaaggatggaacagatcatgagattcgaatgctctgctgcccagcctccgcagggcactttgtatgtccctgtttctcaggctgcagatgaaaaggttcagcatggggtgaccacagcgtacatcactgatgccaccacaccattcctggggggtggtgacacagctgaagtcaggtacatgccaatgcctgttccataaaaccagcaaacaactgctagatgacagccacaggtggagaaggctttatacttcccatctgacgatgaaatccttagaatggaggggacaattttatagtaagacaaaaagatccctgaaatgggaagaaaaccaaacatagtactatcgaaatatatgaatatgttattgatgacactgtcagaacaggcaagtttgagaagttgagaggggtcacagaccaaattagagatttccacattcttgatgatggttaattgtaacacaatccaactgtgcagctgggaatccaacaggctaaggaaaaaggacaccaaaacgaagaagacacagaggtgaggattcacgatgactgggtagtgcagagggcgacagatggctacaaagcagtcataggccatcacagtcaggagcatgccttctatacatgcaacaaggagcaggaaagacatctgtgtcaggcagcccgcatgagagatgactctgctatgcgactgcgtgtccacaatcatcttgggaaccatggccgaggtgaaaccgatgtcaggccagcacaggttggagaggaagaagtacatgggggtgtggagggggcagtcagagctgacagccaggatgctgaacaggttcctcagcaccgtgaccagata

SEQ ID NO: 27 - DNA, 5001 bp, Homo sapiens
acatggacagggacagggacagcaaagcgagggccggctgcagttctggatcctctgagagtcccaggaggaggaattctcagacacctgtgagatattagtcccaacatcccagagggtgtacactacccctgtgatattgtccctaacttccagaggggagaggatgacatcactcccaatatctcagaagttgtacatcccccgtgatattgttcgtcatatccagggaggcgcaggatgacattccattgaatttcgcgacaggcctacacgcacagtgtgatactgttcctactatccaagaagggagaggatgatattactcacaataaagcagtgggtgtacatcacctctgtgttgttgtctctaatatccggggccgggggaggaggggagaggataacattgcctccaatttagcaggtggtttgacgccccttgtgctgttgttttaaatatccagcggggaagacagtagtactatttttgatagtccgattcatcctctccacctttccggaactctgaggccgggaggcggcatgtagtttccgtgcgatccccaatacctttgccgttttctgtaccaaggcagccaaaaacgcaggcccgttgtctgagccgatccataagggcggtcgaaatctaggaatcacatctcgaagaagcacagggattacttcaccagctttctcagttcgtgttggataggcctccacccacccagagtaggtacgcccaagaaccagtacatgcttgttacctccacactttggcatctccgtgaaggtgaagtccacctggagaccttcaaagggggctgctccacaagctcgtatgccgggcggaacggctggaccttgactcccatcttgctgtcagcaggtaacacaccgctgcctcaccgttttggcaagggttgacaaaggcgagatgtagaaataccggcctaacaacttttccagtgactcctgacctcgatgggtgttttcttgcacagccagtacaactgcagctcctagcagctgtggcacagctactctcctatctggtaactgaatccatccttcctccatcacttgtccttccctctacctggagaaagtcctttcttctttagaagaagcaggtccaagatcaggtgcttgagggagcactgatgcccagaagggggcagttgctgcttttcgagcctctgactcagcgcgggaattccccaaacacagcaaggtggaagctcgctggtgtcctctgcaatgcctaactgccaccttgtggggtttccatactgcttctaatcattgcaagatttcttgtggatattttctgtctttccccccagaattcaataggcccttttctttctatcacactccatgcacttgaagggttaaaaagacatactgagaatcagtgtaagtgttgacagtctcaccctcactgagttctaaggcccaaatgaaagcattaagttcagctttctgggctgaagtggcctggggcaacgacctggtttcaacaacagtgtccagagttatcactgcataccctgcacctctctctccttgggggttgaagaagctgctcccatccacgtgtggctcccagtctactgatgcccaagtctggtcccggagctcaggtctgctagagtcaattgagtccaacacttctacacaatcaggctcgacagggctccctgataccggcagcaaggtggcggggtgtagggtgttacaaacttcaatggttatacggggattttcacagaccaaagtttggtacttggtgagcctggcattcgttagccaatgacgtcctttagtattcatcaccacagcacgggaggcctttatgttcaggtttcgcccaagagtcagcttatttgcttcttgtactagcagggcagttgctgccaaggccctccaacaggggggccatcctttagaaactccgtctagtggtttacagaggtaggccaccagcctcagccagggccccacagtttgggttcaaagtccagctgccatcctttctctctctgatgcatacaatggaaaaggctttgtcagatcgggtagcctcagggctggtgctgccagaagtttttcctttaactcatgaaatacttgctgttgttgggatcctcattccaaagattccccgtccccgtcccccttgtgacctcatacaaaaacttggctaatactgcaaagtttgggatccacagtctacaaaaccccacagctcctaagaattctcctacctgccttctgctcttaggctccgctagatggcaaatgacctgctttctttctgatctcgggctgcgttccgacccctgtcggatagtaaatcccaagtaacgtacctgctgtcggcagatctgagctttcttcttggacaccttctacccacagtcctccaggtgcggtgtagggcatctgttcccttggcacacccgactgccgtggggtgtcccagcagaaggtcatcaacctactggagcaacaagcagcctaggtctctgctaggaaacttctggaggtctcgatcccatgcctccccgaagatggtgggggagttcttgaacctttggggaagcccggtccaagtgtactaagtagtgacacctgactccggatcttcccactgaaaggcaaacagcttctgcctctcaggggctaatctgataggaaggaaagcgtcttttaggtccaagcaggtgaaccagctgtcctcagctggcggcaaccccaacaatgtggacgggttaggtactgttggatgtaaagtcagtgtggcttgatgaagcaagcgcaaatcctgtaccggccggtagtccttggtccgtggcttgggaacaggcaggaggggagtgttccatggagactgacaaggaacaatcattccaaacgttcttaggtgcttgagatggacctggataccttgaagggcttctctggggaccgagtcctgtttttgcctcaccggctgggccccagtcttaactggccaatcctggagggttctcttctgcccgaactcttggccagcgcttagccagagctggtcttttctctttgcccgggtcagttcagaaaagtctccattcctcctctcgggggaccataagcgtcataatgactcccattccgggtaactttagcagcaaagagccgtgctctgtgaaagaggcagtggctctcagcttgctgagcaagtcccttcctgaaaagttcaagagactgtcaggcatgtaacaaaactgatgaatgactttatgtcctcctacaggacaagtccaaggcaagcagaaagcttgctttgctgaaacccccgtggctccgatgacgtcagtagtctttttcggtaaggggacaaccggggcggttactagcgaatgttcagcaccgctatctacaagaaagttaatgtctccacccctgactgtcattctgaacagatgtcagaatggggatgcttgagcccggtctccctcagtccaagaacccttccgccaggttgagcagggccccttcctccttgtccggggcctccggctctgagtcaccttcttttcttttgagctgagggcatttgttcttccactgtcctatttctttacaatcagcacactggttacgctgcaaactctgacagccaagctgagtttctttcccagggccccctttcccttgcctctttgcgggggcccctctgattgctgcagctgacaaacaggtcggcgtgtggccgggcctgacctccattctctttgccgttttccttacggcttactgcatacctgtttacaaacacctggctagctatttctagtaattgggatggattcttccctgcaagcccagtctgtttctgcagttttcttctcatgtcttctgcactttgatggactaaagccatgtgaatcatgcgctgattttcagggctatcgggatcaaagggagtatacatatgataggcctcatacagtctctcgtagaattgtgctggactttcttcttttccctgaatgacctcagagagcttgttaacgtttgtggccttctgagctcccctcattaatccttccaagagagcttccctgtctcggtttagcctttgcatctcctctctttcatgtgggtccaactgggggtcggttcctggcaactgggtccttccatactgttcggggttttgataatcagctggtgcatgttcctctagccacttagttgctgcttggaggactctctgcctttcttcactgttaaagaggaaaatgagcaactggtgccaatcggtccaggtgtggttgtgggtctggataacagtttggagcaaatcaattagggcttgtggcttttcggtatagggcgatgtattgtttttccagttgagaaggtcgacgcaggtgaagggctggtacccaaaaacacgtctctccactacatgagcattttcatctatcccagtataccgctgctctctcaggggcatttgtgtccccgttttgggtcgtaaacgagctgccgaggaaggggtggaatggcgcaatgcgacttaccgcaattaataatctcaattattaactgacactaataattatcaatattaataacccataatataattttaaaaatcaatacggatactaatgataattaatattaaatagttatactaacaataacaatacatgattaatattgatgattatgacgcctgatattaataactgatactgatcttattctttagaaaatagtaatattagctcctaataattaatattaatattaataatctgagaactttttattagcaattacttcttaatattaatattaatatcggccattcatattcatgttaataaaaaacaaggaataattcatactaatagtatgccctaatacctcagtgggtgtacacccacctgtgatattgttcctaatgttcagggagggagagagcatgatattacgttc

SEQ ID NO: 28 - DNA, 5001 bp, Homo sapiens
caatatcgcagcaggtgcacacccagccggtgatattgatccgaatataatctccagggggtggagtatgacattactcccaatatagcactgggtgtgcatccacccggtgattttgttcctaatattcatggaagaagagaatgctattactcccaacatcgtaggaagtgtacacccccgtgtgacgtggttcttaataatattccaaggcggagggggtgatatgactacacatatggcagaaagtggacacccccaaggatattgttcccacgatcctggagggaagaggatgatattgctttcagtatcacagaagttggacacgcccccactgatattgtttgtaattgcaacgtgggagaggaggatatgacacgcgatatccgagggagtagaaacacccctgtgatactgttcttaatattcagagagggagaggatgatatgactcccaatacagacggttgtacaacctctgtacgccggggtgaacactggtgggtgaaacagttcacaatctccagagcgggagacgatattactcacaatatgataaacaggctgtgagtccaccgcggatcctaaaaaccaggggggcaagaggggttagctcttactctgcgcatggcggggcgtgcctcaccccctgcgatgggggtcctaagagccaggaggtaagatgggaaggctcttaatacccgcatcaaggggcgtgcctcacaccactgcgatgggggtcctgagagccaggggggcaagaggggctggctcttaccccaagcatagcaggacgtgactcaccccgctgcgatgggggaaactaagagccaggggggcaagagggtttggctcttacaacccgaaacggggggagtgcctcacaacctgcgatgcgggtcctaagagccagggaggcaaggggggatgcgggagacagtggctgtcctccatctaaattgcaagaggctttcctctttgactactccacctcggcacagaccctttacgggtctcaggctgggggacagtcaggtattccccatcccacagggccatatttcagactgttacatggggagaaaccttggacaataacctgctttcaagggtagaggtcgctgcggctttccacggtgcatagtgcccctggtttattgaaactagagaatggcaatgacttttaccaagtatactgcttgtaaacatttggttaacaaagcacatcctgcacagccctagatcccctaaacctcgattttatacaacacaggttttctgagctccaagttgggtcaaaggggctggggcaaagtggatgaggcaaggcaacaaatgaacaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttgctatacatccacaggagcaagaaaacctcagccccactctaccaacacgcacctagtaaaatcccgccaaccgcatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggtagagactcactgaaagatctaggcggggatgtcccatcatgcacaggctctctccattctctgacctgggaacaactctcagcaggattccacatctaggaggcctcggaactcagtgggattttctgagacacaccaactggctgctccctctccgccgctgttgagggtcgttatcttgattatccagatcacctagaaagtatccgtatccagaatgaataagatcaactctctgctcctctgacagcagagggagcaggaccataaggaaccaaagagcgtggaaggaaacgatgtgacaggaaagctcagagaacggccacagggggtcgtcagcaggccttccaacctgaatcatgaataattaatgaagcgcaaatcaaaggggactggagtttcagcaggagcaattcatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattagagcctcacaggcgtccgggagtcgcaagacgagctgaaaaaggagccaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaaggagagtctccttgatgacactgaggcctacgtcgagagagacaaaatgtggtccaattaaaaggtgtctattttaccacattttttaaaacgaaacaaaacaaaacaacaaaaaagatggaaaagaagacaggggtacaggcaccagtgttacatgtctgacggggaacatctattgttcaaagcttgcagctgtacaagtaggttttagaatgtctgtcagcagtggacaggatcttagagtgggctgtgcagatagacctttccaggtcatgtaattggattaagttaattgcaattaaggtacaggtaactgattaggttagggtacgttccatgtcaggtgaccagaggcagtataaaaggcagcctggaaagcagaggtccctctccgccccttcctccgtcgttctggatgctgcatcgcttccagcggggctgctgcagcacctgcccatctcagcgccagcctgggaaagaaagtagacgtgtaacttcaggttagtttcgctgaacaattgtttctttcacgcaatccctgaggggtgttttgcggggggtgtgggggaggaagagacaaaggaggccgaaagaaaccgatcacactggggcttgctggtggggtaggatgtgttctcgttactagtaattcttggaacagaaaacgagaaaacatatccgtctccacgtgtgggagaagaccaagatgggaatgcgaaaagaaatgtactgcagcatgctgaattggtgggtaaacggcaaaaggactttggaaaaaagggtggttggcccttgagccgtgtaagacgtcgatacgatatggcacttcttccccgtttgttcagatgaattcgtgtggtatgcgtaaaataccaggaaaataaataaagaggggctggagctaaagccaaaagatagaacaggaaagaccatcacctgctagtgcggtagagaggaaggtaacttctctgtatgaatttgtgtttggaagttgcctaatgaaatggcaagagtagcgattcaagttgtcacaggaagcatcccttatccctgacttcaagcagacctgccaaagggtggcacacgccatgccctgtgtcttcgatcattctgtccgtcaagggagatagaatcaccgtgtcttctaccggagtgaatcgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcacagcacattgtgtgctacagatttgaccgactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccacatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcacacgggctttgcgagggaacatcgtatccgaactctcccagcacttaacggcccccatgccggtgtcccctctttggaatccttattcagctctgaattcacaatccgtcccaatgttgacgtgggatcgctgcctgtg

SEQ ID NO: 29 - DNA, 5001 bp, Homo sapiens
ggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccgggttgaagccaacccggggcccttgaacaaggataagggagagaaggaagagagaccaaggtgagcagtgggaggggttttcaccactcttggggtactgcctcctaaggacatggtgtctctgcacctgcacaccgtgtgcctttccgtctccgggccagggaaggaacgctgcagagaaataggccggagctccgtgtcctccggggttccacacccaggagctccttgggctctgggagattcagggacggggagaggcgggggcgcttcgtgcaggttccccgccacagcgggaaaagcgatggaatccaaatcacagtccttagttggggagcctagagggccacctggaggatgggaaggttggcacgtgagggaaggtgcagaggcggaaagggcaccagatgtccatttctgtatcacaagacacggaatggggctgggccccagacggggttctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggaaccttctgattatctgagggcgagtgtcaccccgggcccctggtctttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaacatgccgtatttcctgttgctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgccttgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcttggaccctgtcctcgctgatcgctcagctaccgaaatgtctggcaggggctccgtcttggcttcactgtctcccctcagaaaagccagcctgagctcctcctcaagtcttggaccaaaggaaagacagacaggggctgcggccgacatgcctcagcctgcagtcaggcaccagggccgcgagcctctcctcgtggtgaagccgacacacagccgccccgagggtggctgccgagaagttccccaggctgcctccaaaacccacggcctgctccaggccgccagaccccaggcacaagacaaacgtcctgcggtgacctcacagccctgcccgccagccgccacacacagcttgggcctaggctccaatctcagcttcgggccaggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcgtcgaccggcagcctccgcacagcagaccttgcctgcccactgcccaggcctgcaccatgtcccatcacccagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcagactctgtgcggtgactccgaagctccccggctgtggcgcttctgtggatgtgggagcccaggccaggcagggagcagatgcagggactctgcctcattgaattctggtgagggacgttgtagttggcgtggttctcccgaaacgcgccaggaaaagcttccgtgccagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttcctctgtgccccgccctgagagcagagtttcggacgctgggaagcgtgctgtgtgaagcgctctcggggtctttcctcagcctcgaaaactgggctctggaatgcctttgtacatatgtgtgtttaattggttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagatggagaatagaaataagacacagagacaaagtatagggagacaacagtgggtccaggggaccggcactcagcacacctaggacctgcaccggcaccggcctctgagttccctcagtttttattgattatgattatcattattacagcacaaaggaatgcagtaggggagcagggtgataataaggggaagttcaacagcaacaacaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccaacatgtctcgcctcccgccacagggcagcttttctccgagctcagagttgaacaaatgtacgatcgggctttacaccgagacattcagttcccaggggcaagcaggagacagtggccttcctccatctgaactgcaagaggctttcctctttgactaatccacctcagcacagacccattgcgggtgtcaggctgggggacagtcaggtctttcccatcccacgaggccatatttcagactgtcacatggggagaaaccttggacaataccctgctttcaagggcagaggtccctgtggctttccacggtgcattgcgcccctggtttattgagactagggaatggcaatgactcctaccaagtatactgctcgtaaacatttggttaacaaggcgcgtcctgcacagccctagatcccttaaacctcgattttatacaacacaggtttttgtgagctccaagttgggtcaaaggaaggggctgcggcaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttgctatacatccacaggagcaagaaaacctcagccccactctaccaacacgcacctagtaaaattccgccaaccgcatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggtagagactcactgaaagatctaggcggggatatcccatcatgcacaggctctctccattctctgacctgggaacaactctcagcaggattccacatctaggaggcctcggaactcagtgggattttctgagacacaccaactggctgctccctctccgccgctgttgagggtcgttatcttgattatccagatcacctagaaagtatccgtatccagaatgaataagatcaactctctgctcctctgacaacagagggagcaggaccataaggaaccaaagagcgtggaaggaaacgatgtgacaggaaagctcagagaacggccacagggggtcgtcagcaggccttccaacctgaatcatgaataattaatgaagcgcaaatcaaaggggactggagtttcagcaggagcaattcatccaacgggagatcgccggagggccaacaagattgaga

SEQ ID NO: 30 - DNA, 5001 bp, Homo sapiens
agactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattagagcctcacaggcgtccgggagtcgcaagacgagctgaaaaaggagccaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaaggagagtctccttgatgacattgaggcctacgtcgagagagacaaaatgtggtccaattaaaaggtgtctattttaccacattttttaaaacgaaacaaaacaaaacaacaaaaaagatggaaaagaagacagggatacaggcaccagtgttacatgtctgacggggaacatctattgttcaaagcttgcagctgtacaagtaggttttagaatgtctgtcagcagtggacaggatcttagagtgggctgtgcagatagacctttccaggtcatgtaactggattaagttaattgcaattaaggtacaggtaactgattaggttagggtacgttccatgtcaggtgaccagaggcagtataaaaggcagcctggaaagcagaggtccctctccgccccttcctccgtcgttctggatgctgcatcgcttccagcggggctgctgcagcacctgcccatctcagcgccagcctgggaaagaaagtagacgtgtaatttcaggttagtttcgctgaacaattgtttgtttcacgcaatccctgaggggtatttgcggggggtgtgggggaggaagagacaaaggaggccgaaagaaaccgatcacactggggcttgctggtggggtaggatgtgttctcgttactagtaattcttggaacagaaaacgagaaaacatatccgtctccacgtgtgggagaagaccaagatgggaatgcgaaaagaaatgtactgcagcatgctgaattggtgggtaaatggaaaaaggactttggaaaaaaggggggtttgaccttcagccgtgtaagacgtcgatacgatatggcacttcttccccgtttgttcagatgaattcgtgtggtatgcgtaaaataccaggaaaataaataaagaggggctggagctaaagccaaaagatagaacaggaaagaccatcacctgctagtgcggtagagaggaaggtaacttctctgtatgaatttgtgtttggaagttgcctaatgaaatggcaagagtagcgattcaagttgtcacaggaagcatcccttatccctgacttcaagcagacctgccaaagggtggcacacgccatgccctgtgtcttcgatcattctgtccgtcaagggagatagaatcaccgtgtcttctaccggagtgaatcgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcgcagcacattgtgttctacagatttgaccgactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccacatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcacacgggctttgcgagggaacatcgtatccgaactctcccagcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccgggttgaagccaacccggggcccttgaacaaggataagggagagaaggaagagagaccaaggtgagcagtgggaggggttttcaccactcttggggtactgcctcctaaggacatggtgtctctgcacctgcacaccgtgtgcctttccgtctccgggccagggaaggaacgctgcagagaaataggccggagctccgtgtcctccggggttccacacccaggagctccttgggctctgggagattcagggacggggagaggcgggggcgcttcgtgcaggttccccgcgacagcgggaaaagcgatggaatccaaatcacagtccttagttgggaagcctagagggccacctggaggatgggaaggttggcacgtgagggaaggtgcagaggcggaaagggcaccagatgtccatttctgtatcacaagacacggaatggggctgggccccagacggggttctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggaaccttctgattatctgagggcgagtgtcaccccgggcccctggtctttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaacatgccgtatttcctgttgctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgccttgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcgtggaccctgtcctcgctgatggctcagctaccgaaatgtctgacaggggctccgtcttggcttcactgtctcccctcagaaaagccagcctgagctcctcctcaagtcttggaccaaaggaaagacagacaggggctgcggccgacatccctcagcctgcagtcaggcaccagggccgcgagcctctcctcgtggtgaagccgacacacagcagccctgagggtggctgccgagaagttccccaggctgcctccaaaacccacggcctgctccaggccgccagaccccaggcacaagacaaacgtcctgcggtgacctcacagccctgcccgccagccgccacacacagcttgggcctcggctccaatctcagcttcgggccaggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcgtcgaacggcagcctccgcacagcagaccttgcctgcctactgcccaggcctgcaccatgtcccatcactcagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcct

SEQ ID NO: 31 - DNA, 5001 bp, Homo sapiens
tctatgaggaccttcaggtttcctcctcctcagaggacagcgattctgacctggagtgagactgcaggtggcaggggctccttggcctccagctcccgtgacttggaggggactgtgggactgaggagcgcagagcagagagcagactctgtgcggtgactccgaagctccccggctgtggcgcttctgtggatgtgggagcccaggccaggcagggagcagatgcagggactctgcctcattgaattctggtgagggacgttgtagttggcgtggttctcccgaaacgcgccaggaaaagcttccgtgccagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttccgctgtgccccgccctgagagcagagtttcggacgctgggaagcgtgctgtgtgaagcgctctcggggtctttcctcagcctcgaaaactgggctctggaatgcctttgtacatatgtgtgtttaattggttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagatggagaatagaaataagacacagagacaaagtatagggagacaacagtgggtccaggggaccggcactcagcacacctaggacctgcaccggcaccggcctctgagttccctcagtttttattgattatgattatcattattacagcacaaaggaatgcagtaggggagcagggtgataataaggggaagttcaacagcaacaacaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccaacatgtctcgcctcccgccacagggcagcttttctccgagctcagagttgaacaaatgtacgatcgggctttacaccgagacattcagttcccaggggcaagcaggagacagtggccttcctccatctgaactgcaagaggctttcctctttgactaatccacctcagcacagacccattgcgggtgtcaggctgggggacagtcaggtctttcccatcccacgaggccatatttcagactgtcacatggggagaaaccttggacaataacctgctttcaagggcagaggtccctgtggctttccacggtgcattgcgcccctggtttattgagactagggaatggcaatgactcctaccaagtatactgctcgtaaacatttggttaacaaggcgcgtcctgcacagccctagatcccttaaacctcgattttatacaacacaggtttttgtgagctccaagttgggtcaaaggaaggggctgcggcaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttgctatacatccacaggagcaagaaaacctcagccccactctaccaacacgcacctagtaaaattccgccaaccgcatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggtagagactcactgaaagatctaggcggggatatcccatcatgcacaggctctctccattctctgacctgggaacaactctcagcaggattccacatctaggaggcctcggaactcagtgggattttctgagacacaccaactggctgctccctctccgccgctgttgagggtcgttatcttgattatccagatcacctagaaagtatccgtatccagaatgaataagatcaactctctgctcctctgacagcagagggagcaggaccataaggaaccaaagagcgtggaaggaaacgatgtgacaggaaagctcagagaacggccacagggggtcgtcagcaggccttccaacctgaatcatgaataattaatgaagcgtaaatcaaaggggactggagtttcagcaggagcaattcatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattagagcctcacaggcgtccgggagtcgcaagacgagctgaaaaaggagccaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaaggagagtctccttgatgacactgaggcctacgtcgagagagacaaaatgtggtccaattaaaaggtgtctattttaccacattttttaaaacgaaacaaaacaaaacaacaaaaaagatggaaaagaagacagggatacaggcaccagtgttacatgtctgacggggaacatctattgttcaaagcttgcagctgtacaagtaggttttagaatgtctgtcagcagtggacaggatcttagagtgggctgtgcagatagacctttccaggtcatgtaactggattaagttaattgcaattaaggtacaggtaactgattaggttagggtacgttccatgtcaggtgaccagaggcagtataaaaggcagcctggaaagcagaggtccctctccgccccttcctccgtcgttctggatgctgcatcgcttccagcggggctgctgcagcacctgcccatctcagcgccagcctgggaaagaaagtagatgtgtaatttcaggttggtttcgctgaacaattgtttgtttcacgcaatccctgggggggttttgcggggggtgtgggggaggaagagacaaaggaggccgaaagaaaccgatcacactggggcttgctggtggggtaggatgtgttctcgttactagtaattcttggaacagaaaacgagaaaacatatccgtctccacgtgtgggagaagaccaagatgggaatgcgaaaagaaatgtactgcagcatgctgaattggtgggtaaatggaaaaaggactttggaaaaaaggggggtttgaccttcagccgtgtaagacgtcgatacgatatggcacttcttccccgtttgttcagatgaattcgtgtggtatgcgtaaaataccaggaaaataaataaagaggggctggagctaaagccaaaagatagaacaggaaagaccatcacctgctagtgcggtagagaggaaggtaacttctctgtatgaatttgtgtttggaagttgcctaatgaaatggcaagagtagcgattcaagttgtcacaggaagcatcccttatccctgacttcaagcagacctgccaaagggtggcacacgccatgccctgtgtcttcgatcattctgtccgtcaagggagatagaatcaccgtgtcttctaccggagtgaatcgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcgcagcacattgtgttctacagatttgaccgactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccacatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctt

SEQ ID NO: 32 - DNA, 5001 bp, Homo sapiens
ttctacttagagtcctgtgtagccacgtttggctgcgttgttgacatcggcttcaccatcgtgccccttggaaccttgagtccttcctttcagagttcctccgtcacacgggctttgcgagggaacatcgtatccgaactctcccagcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccgggttgaagccaacccggggcccttgaacaaggataagggagagtaggaagagagaccaaggtgagcagtgggaggggttttcaccactcttggggtactgcctcctaaggacatggtgtctctgcacctgcacaccgtgtgcctttccgtctccgggccagggaaggaacgctgcagagaaataggccggagctccgtgtcctccggggttccacacccaggagctccttgggctctgggagattcagggacggggagaggcgggggcgcttcgtgcaggttccccgccacagcgggaaaagcgatggaatccaaatcacagtccttagttggggagcctagagggccacctggaggatgggaaggttggcacgtgagggaaggtgcagaggcggaaagggcaccagatgtccatttctgtatcacaagacacggaatggggctgggccccagacggggttctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggaaccttctgattatctgagggcgagtgtcaccccgggcccctggtctttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaacatgccgtatttcctgttgctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgccttgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcgtggaccctgtcctcgctgatggctcagctaccgaaatgtctggcaggggctccgtcttggcttcactgtctcccctcagaaaagccagcctgagctcctcctcaagtcttggaccaaaggaaagacagacaggggctgcggccgacatgcctcagcctgcagtcaggcaccagggccgcgagcctctcctcgtggtgaagccgacacacagcagccctgagggtggctgccgagaagttccccaggctgcctccaaaacccacggcctgctccaggccgccagaccccaggcacaagacaaacgtcctgcggtgacctcacagccctgcccgccagccgccacacacagcttgggcctcggctccaatctcagcttcgggccaggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcgtcgaacggcagcctccgcacagcagaccttgcctgcctactgcccaggcctgcaccatgtcccatcactcagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcagactctgtgcggtgactccgaagctccccggctgtggcgcttctgtggatgtgggagcccaggccaggcagggagcagatgcagggactctgcctcattgaattctggtgagggacgttgtagttggcgtggttctcccgaaacgcgccaggaaaagcttccgtgccagagattcgttgcctcagaaactgcgtgacgcgcaggagtcagacttccgctgggacgtcaataggaaactggggaattactgtgtatttgctgtctagatgactgaataagggaaaagttagggaaccctgagaggtgcagcccttccgctgtgccccgccctgagagcagagtttcggacgctgggaagcgtgctgtgtgaagcgctctcggggtctttcctcagcctcgaaaactgggctctggaatgcctttgtacatatgtgtgtttaattggttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagatggagaatagaaataagacacagagacaaagtatagggagacaacagtgggtccaggggaccggcactcagcacacctaggacctgcaccggcaccggcctctgagttccctcagtttttattgattatgattatcattattacagcacaaaggaatgcagtaggggagcagggtgataataaggggaagttcaacagcaacaacaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccaacatgtctcgcctcccgccacagggcagcttttctccgagctcagagttgaacaaatgtacgatcgggctttacaccgagacattcagttcccaggggcaagcaggagacagtggccttcctccatctgaactgcaagaggctttcctctttgactaatccacctcagcacagacccattgcgggtgtcaggctgggggacagtcaggtctttcccatcccacgaggccatatttcagactgtcacatggggagaaaccttggacaataccctgctttcaagggcagaggtccctgtggctttccacggtgcattgcgcccctggtttattgagactagggaatggcaatgactcctaccaagtatactgctcgtaaacatttggttaacaaggcgcgtcctgcacagccctagatcccttaaacctcgattttatacaacacaggtttttgtgagctccaagttgggtcaaaggaaggggctgcggcaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttgctatacatccacaggagcaagaaaacctcagccccactctaccaacacgcacctagtaaaatcccgccaaccgcatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggtagagactcactgaaagatctaggcagggatatcccatcatgcacaggctctctccattctctgacctgggaacaactctcagcaggattccacatctaggaggcctcggaactcagtgggattttctgagacacaccaactggctgctccctctccgccgctgttgagggtcgttatcttgattatccagatcacctagaaagtatccgta

SEQ ID NO: 33 - DNA, 5001 bp, Homo sapiens
atccagaatgaataagatcaactctctgctcctctgacagcagagggagcaggaccataaggaaccaaagagcgtggaaggaaacgatgtgacaggaaagctcagagaacggccacagggggtcgtcagcaggccttccaacctgaatcatgaataattaatgaagcgcaaatcaaaggggactggagtttcagcaggagcaattcatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattagagcctcacaggcgtccgggagtcgcaagacgagctgaaaaaggagccaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaaggagagtctccttgatgacactgaggcctacgtcgagagagacaaaatgtggtccaattaaaaggtgtctattttaccacattttttaaaacgaaacaaaacaaaacaacaaaaaagatggaaaggaagacaggggtacaggcaccagtgttacatgtctgacggggaacatctattgttcaaagcttgcagctgtacaagtaggttttagaatgtctgtcagcagtggacaggatcttagagtgggctgtgcagatagacctttccaggtcatgtaattggattaagttaattgcaattaaggtacaggtaactgattaggttagggtacgttccatgtcaggtgaccagaggcagtataaaaggcagcctggaaagcggaggtccctctccgccccttcctccgtcgttctggatgctgcatcgcttccagcggggctgctgcagcacctgcccatctcagcgccagcctgggaaagaaagtagacgtgtaatttcaggttagtttcgctgaacaattgtttgtttcacgcaatccctgaggggtttttgcggggggtgtgggggaggaagagacaaaggaggccgaaagaaaccgatcacactggggcttgctggtggggtaggatgtgttctcgttactagtaattcttggaacagaaaacgagaaaacatacccgtctccacgtgtgggagaagaccaagatgggaatgcgaaaagaaatgtactgcagcatgctgaattggtgggtaaacggcaaaaggactttggaaaaaagggtggttggcccttgagccgtgtaagacgtcgatacgatatggcacttcttccccgtttgttcagatgaattcgtgtggtgtgcgtaaaataccaggaaaataaataaagaggggctggagctaaagccaaaagatagaacaggaaagaccatcacctgctagtgcggtagagaggaaggtaacttctctgtatgaatttgtgtttggaagttgcctaatgaaatggcaagagtagcgattcaagttgtcacaggaagcatcccttatccctgacttcaagcagacctgccaaagggtggcacacgccatgccctgtgtcttcgatcattctgtccgtcaagggagatagaatcaccgtgtcttctaccggagtgaatcgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcgcagcacattgtgttctacagatttgaccgactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccacatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcacacgggctttgcgagggaacatcgtatccgaactctcccagcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccggggtgaagccaacccggggcccttgaacaaggataagggagagaaggaagagagaccaaggtgagcagtgggaggggttttcaccactcttggggtactgcctcctaaggacatggtgtctctgcacctgcacaccgtgtgcctttccgtctccgggccagggaaggaacgctgcagagaaataggccggagctccgtgtcctccggggttccacacccaggagctccttgggctctgggagattcagggacggggagaggcgggggcgcttcgtgcaggttccccgcgacagcgggaaaagcgatggaatccaaatcacagtccttagttgggaagcctagagggccacctggaggatgggaaggttggcacgtgagggaaggtgcagaggcggaaagggcaccagatgtccatttctgtatcacaagacacggaatggggctgggccccagacggggttctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggaaccttctgattatctgagggcgagtgtcaccccgggcccctggtctttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaacatgccgtatttcctgttgctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccagcaacctgccttgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcttggaccctgtcctcgctgatcgctcagctaccgaaatgtctggcaggggctccgtcttggcttcactgtctcccctcagaaaagccagcctgagctcctcctcaagtcttggaccaaaggaaagacagacaggggctgcggccgacatgcctcagcctgcagtcaggcaccagggccgcgagcctctcctcgtggtgaagccgacacacagccgccccgagggtggctgccgagaagttccccaggctgcctccaaaacccacggcctgctccaggccgccagaccccaggcacaagacaaacgtcctgcggtgacctcacagccctgcccgccagccgccacacacagcttgggcctaggctccaatctcagcttcgggccaggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcgtcgaccggcagcctccgc

SEQ ID NO: 34 - DNA, 5001 bp, Homo sapiens
cacagcagaccttgcctgcccactgcccaggcctgcaccatgtcccatcacccagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcagactctgtgcggtgactccgaagctccccggctgtggcgcttctgtggatgtgggagcccaggccaggcagggagcagatgcagggactctgcctcattgaattctggtgagggacgttgtagttggcgtggttctcccgaaacgcgccaggaaaagcttccgtgccagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttcctctgtgccccgccctgagagcagagtttcggacgctgggaagcgtgctgtgtgaagcgctctcggggtctttcctcagcctcgaaaactgggctctggaatgcctttgtacatatgtgtgtttaattggttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagatggagaatagaaataagacacagagacaaagtatagggagacaacagtgggtccaggggaccggcactcagcacacctaggacctgcaccggcaccggcctctgagttccctcagtttttattgattatgattatcattattacagcacaaaggaatgcagtaggggagcagggtgataataaggggaagttcaacagcaacaacaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccaacatgtctcgcctcccgccacagggcagcttttctccgagctcagagttgaacaaatgtacgatcgggctttacaccgagacattcagttcccaggggcaagcaggagacagtggccttcctccatctgaactgcaagaggctttcctctttgactaatccacctcagcacagacccattgcgggtgtcaggctgggggacagtcaggtctttcccatcccacgaggccatatttcagactgtcacatggggagaaaccttggacaataccctgctttcaagggcagaggtccctgtggctttccacggtgcattgcgcccctggtttattgagactagggaatggcaatgactcctaccaagtatactgctcgtaaacatttggttaacaaggcgcgtcctgcacagccctagatcccttaaacctcgattttatacaacacaggtttttgtgagctccaagttgggtcaaaggaaggggctgcggcaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttgctatacatccacaggagcaagaaaacctcagccccactctaccaacacgcacctagtaaaattccgccaaccgcatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccatggttctccccctgatcctaagagtagctgaggtagagactcactgaaagatctaggcggggatgtcccatcatgcacaggctctctccattctctgacctgggaacaactctcagcaggattccacatctaggaggcctcggaactcagtgggattttctgagacacaccaactggctgctccctctccgccgctgttgagggtcgttatcttgattatccagatcacctagaaagtatccgtatccagaatgaataagatcaactctctgctcctctgacagcagagggagcaggaccataaggaaccaaagagcgtggaaggaaacgatgtgacaggaaagctcagagaacggccacagggggtcgtcagcaggccttccaacctgaatcatgaataattaatgaagcgcaaatcaaaggggactggagtttcagcaggagcaattcatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattagagcctcacaggcgtccgggagtcgcaagacgagctgaaaaaggaggcaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaaggagagtctccttgatgacactgaggcctacgtcgagagagacaaaatgtggtccaattaaaaggtgtctattttaccacattttttaaaacgaaacaaaacaaaacaacaaaaaagatggaaaagaagacagggatacaggcaccagtgttacatgtctgacggggaacatctattgttcaaagcttgcagctgtacaagtaggttttagaatgtctgtcagcagtggacaggatcttagagtgggctgtgcagatagacctttccaggtcatgtaactggattaagttaattgcaattaaggtacaggtaactgattaggttagggtacgttccatgtcaggtgaccagaggcagtataaaaggcagcctggaaagcagaggtccctctccgccccttcctccgtcgttctggatgctgcatcgcttccagcggggctgctgcagcacctgcccatctcagcgccagcctgggaaagaaagtagacgtgtaatttcaggttagtttcgctgaacaattgtttgtttcacgcaatccctgaggggtttttgcggggggtgtgggggaggaagagacaaaggaggccgaaagaaaccgatcacactggggcttgctggtggggtaggatgtgttctcgttactagtaattcttggaacagaaaacgagaaaacatatccgtctccacgtgtgggagaagaccaagatgggaatgcgaaaagaaatgtactgcagcctgctgaattggtgggtaaacggcaaaaggactttggaaaaaagggtggttggcccttgagccgtgtaagacgtcgatacgatatggcacttcttccccgtttgttcagatgaattcgtgtggtatgcgtaaaataccaggaaaataaataaagaggggctggagctaaagccaaaagatagaacaggaaagaccatcacctgctagtgcggtagagaggaaggtaacttctctgtatgaatttgtgtttggaagttgcctaatgaaatggcaagagtagcgattcaagttgtcacaggaagcatcccttatccctgacttcaagcagacctgccaaagggtggcacacgccatgccctgtgtcttcgatcattctgtccgtcaagggagatagaatcaccgtgtcttctaccggagtgaatcgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcgcagcacattgtgttctacagatttgaccgactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccacatcttgggccaagagactggtgagagcccagaccctccagaagcagcggagggccccagttggg

SEQ ID NO: 35 - DNA, 5001 bp, Homo sapiens
gccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcacacgggctttgcgagggaacatcgtatccgaactctcccagcacttaacggcccccatgccggtgtcccctctttggaatccttattcagctctgaattcacaatccgtcccaatgttgacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagccccgggttgaagccaacccggggcccttgaacaaggataagggagagaaggaagagagaccaaggtgagcagtgggaggggttttcaccactcttggggtactgcctcctaaggacatggtgtctctgcacctgcacaccgtgtgcctttccgtctccgggccagggaaggaacgctgcagagaaataggccggagctccgtgtcctccggggttccacacccaggagctccttgggctctgggagattcagggacggggagaggcgggggcgcttcgtgcaggttccccgcgacagcgggaaaagcgatggaatccaaatcacagtccttagttgggaagcctagagggccacctggaggatgggaaggttggcacgtgagggaaggtgcagaggcggaaagggcaccagatgtccatttctgtatcacaagacacggaatggggctgggccccagacggggttctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggaaccttctgattatctgagggcgagtgtcaccccgggcccctggtctttttctcctctaggtcaccctggttgatttcctttcagcttcccgtctgcgggaggaaatcggggaacccctctttcttgccttcttggggtcagggactccacgatccttccaggtcaattggattccaggcgaaggcatctgaacatgccgtatttcctgttgctttctttctgtccaattatggcaagcctgccaacaacacgttcctagcggcatgaggaaattagtccctcagaggccccaaacgtggagaaggcgaaacccaggaacatgcatgtgttcagagaagacgtcccgagtacccttgagccaccaacctgccttgggaagggcattagtccgttccacttcatggaaggctgagtggaggcgctttgatccagttaatgcccaagacgcgatcttttgaacaatggtgtgcttagatcagctacacatagctcgagagcgcatctttcatgtgtcttgtcctgatcagcactcaggtggagggtctgtccctacttccaaggaccgcctgtcgatactgtactaagaatttcatggcgtgtgcaccttgtctttggatgtgcttgattttcacgttggctccatgctgaggaacttctaacctgtgttgtttcctctctttcaggttgcaagcgggccaatgccggtccacacaaccagtaagaggccgcgcgtggaccctgtcctcgctgatggctcagctaccgaaatgtctgacaggggctccgtcttggcttcactgtctcccctcagaaaagccagcctgagctcctcctcaagtcttggaccaaaggaaagacagacaggggctgcggccgacatgcctcagcctgcagtcaggcaccagggccgcgagcctctcctcgtggtgaagccgacacacagccgccccgagggtggctgccgagaagttccccaggctgcctccaaaacccacggcctgctccaggccgccagaccccaggcacaagacaaacgtcctgcggtgacctcacagccctgcccgccagccgccacacacagcttgggcctaggctccaatctcagcttcgggccaggagccaagagacctgcccaggctccgattcaggcttgcctgaacttccccaagaaaccgagactgggtcccttccagatccccgaaagcgccatccagggaggtgagctgggggccccggagaatctccaacctccgccagccgcaaccgaacttggaccaagtacgtcgccccagatgggcaggaggacaccggcccaggtgcccagcgtcgaccggcagcctccgcacagcagaccttgcctgcccactgcccaggcctgcaccatgtcccatcacccagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtggggctgaggagcgcagagcagagagcacactctgtgcggtgactccgaagctccccggctgtggcgcttctgtggatgtgggagcccaggccaggcagggagcagatgcagggactctgcctcattgaattctggtgagggacgttgtagttggcgtggttctcccgaaacgcgccaggaaaagcttccgtgccagagattcgttgcctcagaaactgcgtgacgcgcaggagtcagacttccgctgggacgtcaataggaaactggggaattactgtgtatttgctctctagatgactgaataagggaaaagttagggaaccctgagaggtgcagcccttcctctgtgccccgccctgagagcagagtttcggacgctgggaagcgtgctgtgtgaagcgctctcggggtctttcctcagcctcgaaaactgggctctggaatgcctttgtacatatgtgtgtttaattggttttgaagtgaataaaattctcaaaaagatgacatattgtcttttgactctcattccgtgtttgtgtgtaactgattttccaagtgaaggggtggcctgcccctccacacctgtgggtgtttctagtcgggtgggatgagagatggagaatagaaataagacacagagacaaagtatagggagacaacagtgggtccaggggaccggcactcagcacacctaggacctgcaccggcaccggcctctgagttccctcagtttttattgattatgattatcattattacagcacaaaggaatgcagtaggggagcagggtgataataaggggaagttcaacagcaacaacaaaaacaaacacgtgagcaaaagaatccatatcattattaagttcaagggaaggtactatgcctggacgtgcacgtaggccagatttatgtttctctccacacaaatatctcagcggagtaaagaataacaaggcagcattactgccaacatgtctcgcctcccgccacagggcagcttttctccgagctcagagttgaacaaatgtacgatcgggctttacaccgagacattcagttcccaggggcaagcaggagacagtggccttcctccatctgaactgcaagaggctttcctctttgactaatccacctcagcacagacccattgcgggtgtcaggctgggggacagtcaggtctttcccatcccacgaggccatatttcagactgtcacatggggagaaaccttggacaataccctgctttcaagggcagaggtccctgtggctttccacggtgcattgcgcccctggtttattgagactagggaatggcaatgactcctaccaagtatactgctcgtaaacatttggttaacaaggcgcgtcctgcacagccctagatcccttaaacctcgattttatacaacacaggtttttgtgagctccaagttgggtcaaaggaaggggctgcggcaaagctacaaatgatcaacatctcagcaaagcaattgtttaaactacaggtctttttcaaaatggagtctcttatgtcttccccttctacatagacacagtgacagtctgatctctctttctttaccctacatccaagggcttgaacatttcttgacttgttggcaatccaaatcgttacgtctccgaaacagagttgactgaggggaccgcagggctgggcaggacctttgacttgctatacatccacaggagcaagaaaacctcagccccactctaccaacacgcacctagtaaaattccgccaaccgcatctcacgcacgctaacacgtggggagcgttgcttgcaccacgagtccccatttggctcaaccgccgatgccaagtgtgtggttccagttgcgacggccccccgtgaagtggcttccggatgtgcgaaggaaccaggcagagtttcactggccaaatagaccccagcaaagctgaagttaactcccacatttgggatgtacttcagaggtaaaacattcatcccgtcttctttccggatgtctgacaccat

SEQ ID NO: 36 - DNA, 5001 bp, Homo sapiens
tggttctccccctgatcctaagagtagctgaggtagagactcactgaaagatctaggcggggatgtcccatcatgcacaggctctctccattctctgacctgggaacaactctcagcaggattccacatctaggaggcctcggaactcagtgggattttctgagacacaccaactggctgctccctctccgccgctgttgagggtcgttatcttgattatccagatcacctagaaagtatccgtatccagaatgaataagatcaactctctgctcctctgacagcagagggagcaggaccataaggaaccaaagagcgtggaaggaaacgatgtgacaggaaagctcagagaacggccacagggggtcgtcagcaggccttccaacctgaatcatgaataattaatgaagcgcaaatcaaaggggactggagtttcagcaggagcaattcatccaacgggagatcgccggagggccaacaagattgagagactgggagccgggtgcagtgtcaaaggggacgcgactggttccaaagctcgagaagaccatggggtcacttgggctacatgagaaaacgccccagtgtgctggttcatcattccgactcctgcctgtctcttcccgtccaaggaacatggaccctaagtcgtgcaggtgcggatgaccatgggcagaattaggggccgtggcacaaaagttcaccgacacgggagttccacagaaggtgcggtggatcttcgcaaatccagagacatggcaatgggacccagggaattagagcctcacaggcgtccgggagtcgcaagacgagctgaaaaaggaggcaggcactgaaggacaaagcgttgttgactttcctcatctgtgtttcccagtgcggtccaattcacggtggtttccaagcgcctcctgggggagaaaacacatgagggtgcggtcagggttctctgctgacagacttaccttggggaagaaagagaagctctgaagatggatcatggccgtgactgcatgtcaaggagagtctccttgatgacactgaggcctacgtcgagagagacaaaatgtggtccaattaaaaggtgtctattttaccacattttttaaaacgaaacaaaacaaaacaacaaaaaagatggaaaagaagacagggatacaggcaccagtgttacatgtctgacggggaacatctattgttcaaagcttgcagctgtacaagtaggttttagaatgtctgtcagcagtggacaggatcttagagtgggctgtgcagatagacctttccaggtcatgtaattggattaagttaattgcaattaaggtacaggtaactgattaggttagggtacgttccatgtcaggtgaccagaggcagtataaaaggcagcctggaaagcagaggtccctctccgccccttcctccgtcgtcctggatgctgcatcgcttccagccgggctgctgcagcacctgcccatctcagcgccagcctgggaaagaaagtagacgtgtaacttcaggttagtttcgctgaacaattgtttgtttcacgcaatccctgaggggtttttgcggggggtgtgggggaggaagagacaaaggaggccgaaagaaaccgatcacactggggcttgctggtggggtaggatgtgttctcgttactagtaattcttggaacagaaaacgagaaaacatatccgtctccacgtgtgggagaagaccaagatgggaatgcgaaaagaaatgtactgcagcatgctgaattggtgggtaaacggcaaaaggactttggaaaaaagggtggttggcccttgagccgtgtaagacgtcgatacgatatggcacttcttccccgtttgttcagatgaattcgtgtggtatgcgtaaaataccaggaaaataaataaagaggggctggagctaaagccaaaagatagaacaggaaagaccatcacctgctagtgcggtagagaggaaggtaacttctctgtatgaatttgtgtttggaagttgcctaatgaaatggcaagagtagcgattcaagttgtcacaggaagcatcccttatccctgacttcaagcagacctgccaaagggtggcacacgccatgccctgtgtcttcgatcattctgtccgtcaagggagatagaatcaccgtgtcttctaccggagtgaatcgtgagagacctaagtccagtctccagaatcagttgtttgtttggggttgaaagctcaaccccccatacctaggccacgggccctgtggcaggtggggtttactcttggactaggtagtcatggcagaggaacacacaatatccgaggatgcgcacagcacattgtgttctacagatttgaccgactggtggtgaggtctcctcatgaccacacaggcagggagttagcaggtggcttcctgtgggtgtgtgaatatccaacgtgcttaaccatcgacatgtgtgtgtttgtgtgtgtttcaggtggcccaacagtccacccctgaaaaaggcggtcataaaacccccaggagacgaagatgatggcacgtcgggaccccacatcttgggccaagagactggtgagagcccagaccctccagaagcagcggagggccccagttgggccaagggctcccccgcccgatgaagaagatcccagggtaagtctagccctggatctcttgggtatcggggtgggggtggggacggggggagggggtgtcccacggtcctcagagactgggttggattccaaagagttctgtcaccaccagccaggttgcttttcccatccaaggtgggcgtggcttgggaccttctccccggcccgataggtcccttgagagactcttgggggcaacctccctttctacttagagtcctgtgtagccacgtttggctgcgttgttgacatcggcttcaccatcgtgccccttggaaccttgagtccttcctttcagagttcctccgtcacacgggctttgcgagggaacatcgtatccgaactctcccagcacttaacggcccccatgccggtgtcccctctttggaatccttattcagctctgaattcacaatccatcccaatgttaacgtgggatcgctgcctgtggcttcagctcactcactgacatcacttcctttccacccacagctcaagtgcaaaaactgcggggcctttggccacacggccagaagtaccaggtgccccatgaagtgctggaaggcagccctggttccagcgaccttggggaaaaaggaagggaaggaaaacctgaaaccatggaagcctggggttgaagccaacccggggcccttgaacaaggataagggagagaaggaagagagaccaaggtgagcagtgggaggggttttcaccactcttagggtactgcctcctaaggacatggtgtctctgcacctgcacaccgtgtgcctttccgtctccgggccagggaaggaacgctgcagagaaataggccggagctccgtgtcctccggggttccacacccaggagctccttgggctctgggagattcagggacggggagaggcgggggcgcttcatgcaggttccccacgacagggggaaaagcaatggaatccaaatcacagtccttagttgggaagcctagagggccacctggaggatgggaaggttggcacgtgagggaaggtgcagaggcggaaagggcaccagatttccatttctgtatcacaagacacggaatggggctgggccccagacggggttctccctgtctcctggggaaaaccagggggcacggcctgacctttttctgttctgcaggcaacaagacccgcagaggaaggctctcctccacatgttttccgggaaacctccagagaagccgctgccgaatggaaaaggatccacggaatcttctgattatctgagggtgagtgtcaccccgggcccctggtccttttatcctctaggtaaccctggttgatttcctttcagcttcccgtctgcgggaggaaatcggggaacccctctttcttgtcttcttggggtcagggcctccacgatccttgcaggtcagtttgattccaggcgaagtcatctgaagatgccgtatttcctgtggctttctttctgtccaattatggcaagcctgccaacaacacgttcctagcggcatgaggaaattagtccctcagaggccgcaaacgtggagaaggctaaacccaggaacatgcatgtgttcatagaagacgtcccgagtacccttgagccaccaacctgccttcggaaagccattagtccgttccacttcatggaaggctgagtggaggcactttgatccagttaatgcccaagacgcaatcttttgaacaatggtgtgcttagatcagctacacatagctcgatagcgcatcgttcatgtgtcttttcctgatcagcactcaggtggagggtctgtccctacttccaaggaccgcctgtcgatactgtactaagaatttcatggtgtgtgcaccttgtctttggatgtgtttgattttcatgttggctccatgctgaggaacttctaacctgtgttgtttcctctctttcaggttgcaagggggccaatgccggtccacacaacctgtaagaggccgcgcatggaccctgtcctctctggtcgctcagctaccgaaatgtctggcaggggctccgtcttggcttcactgtctcccctcagaaaagccagtctgagctcctcctcaagtcttggaccaaaggaaagacagacaggggctgccgccgacatccctcggcctgcagtcaggcaccaggtccacgagactctcctcgtggtggagccgacacacagcagccctgagggtagctgccgagaagttccccaggctgcctccaaaacccacggcctgctccaggccgtcagaacccaggcacaagacaaacgtcctgcggtgacctcacagccctgcccatcagccgccacacacagcttgggcctaggctccaat

SEQ ID NO: 37 - DNA, 5001 bp, Homo sapiens
tctcagctttgggtcaggagccaagagacctgcccaggctccgattcaggcttgcctgaacttccccaagaaaccgagactgggtcccttccagatccccgaaagcaccatccagggaggtgagctgggggccccggagaatctccaacctccaccagccgcaaccgaacttggaccaagtaggtcgccccagatgggcaggaggacaccggcccaggtgcccagcgttgaacggcagcctccgcaccgcagaccttgcctgcctactgcccaggcctgcaccatgtcccatcacccagcggccagccatgatggggcccagcctctcagagtgctcttccggagactggaaaacggacgctggagctccagcctcctggcggccccctcatttcactctcctgagaagccgggagccttcctcgctcagagccctcatgtgtcagagaagtctgaggctccctgtgttcgtgtcccaccgagcgtcctctatgaggaccttcaggtttcctcctcctcagaggacagcgattctgacctggagtgagactgcaggtggcaggggctccttggcctccagctcccgtgacttggaggggactgtgggactgaggagcgcagagcagagagcagactctgcgctgacttcgatgctccccggctgtcgcgcttctgtggatgtgggagcccaggccaggcagagaacagatgcagggactctgcctcattgaattctggtgagggacattgtatttcgcatgggtctccagaaacgcaccaggaaaagcttccgcgtcagtgattctttgcgtcagaaactgcgtgatgcgctggagtcagacttccgctgggacgtcaataggaaactagggaattactgtgtatttgctctttagatgactgaataagggaaaagttagggaaccctgagaggtgcagcccttcctctgtgctccgccttgagagcagtgtttcggacgctgggaagcgtgctgtgcaaagtgctctcggggtctttcctcagcctcgaaaactgggctctggaatgcctttgtaaatatgtgtgttgaatttgttttgaagtgaataaaattctcaaaaagatgacatattgtcttttgactctcattccgtgtttgtgtttaactgattttccaagtgtagggatcgcctgcccctccacacctgtgggtgtttctagtcgggtgggatgagagacggagaaaagaaataagacacagaggcaaagtatagggagacaaaagtgggtccaggggaccggcactcagcacaccaaggacctgcaccggcaccggcctctgagttccctcatttttaattgattatgattttcattatttcagcaaaaaggaatgtagtaggagagcagggtgataataaagagaaggtcaaccaaaaaaacatgtgagcaaagcaatctatatcataattaagttcaagggaaggtactatgcctggacgtgcacgtaggccagatttatgtttctctccacccaaacatctcagcggagtaaagaataacagggcagcattactgccaacatgtctcgcctcgcgccacagggcagcttttctcctagctcagagttgaacaaatgtacgatcggattttacaccgagacattcagctcccaggggcgagcaggagacagtggccttcctccatctcaactacaagaggctttcctctttgactaatccacctcagcacagacgctttaccggtgtcaggctaggggacagtcaggtcttttttatcccacaaggccatatttcagagtatcgcatcgggagaaaccttggacaatgccctactttcaagggcagacgtccctgcagctttccacggtgcattgtgcccctggtttattgagactagagaatggccacgacttttaccaagtatacggcttgtaaacatttggttaacaaggcacgtcctgcacagccctagatcccttaagccttgattttatacaacacaggtttttgtgagctccaagttgggtcaaagcggctggggcaaagtgcctggggcaaagctacaaatgaacaacatctcagcaaagcaattgtttaaagtacaggtcttttccaaaatggagtctcttatgtcttccctttcgacatagacacagtgacagtctgatctctctttcttttccctacatccaagggcttgaacatttcttgacttgttagcaatccaaatcgttatgtctccgaaacagagttgactgaggggaccgcacggctgggcaggacctttgacttcgtatacatccacaggagaaagagaacctcagccccactctaccaacacgcacctagtaaaattccgccaactgaatctcacgcacgctaacacgtggggagcgttgcttgcaccgcgagtccccatttggctcaaccgcctatgccaagtgtgtggttccggttgcgacggccccccgtgaagtggcttccggatgtgcgaatgaaccaggcagagtttcactgaccaaatagtccccagcaaagctgtagttaactcccagatttgggatgtacttcagaggtaaaacattcatcccatcttctttccggatgtctgacaccgggcctttccatggttctcccactgatcctaagagtagctgaggtagagactcactgaaagatctaggcagggatatctcatcatgcacagactctctctattctctgacctgggaacaactctgagcaggattccacatctaggaggcctcggaactgagcggtattttctgagacacactgaatggctgctccctttccgccgctgttgagggtcgttatcttgattatccagatcacctagaaagtatccgtatccagaatcaataagatctactctctgctcctctgacagcagaagcagcaggaccacaatgaaccaaagagcgtggaaggaaacgatgtgaccggaaagctcagagaacggccacagggagtcgtaagcaggccttccaaactgaatcatgaataattaatgaagcgcaaatcaaaggggactcgagtttcagcaggtgcaattcatccaaagggagatcgccggagggccaacaagattgagaaactgggagtcgggtgcagtgtcaagggggacgcgactggttccaaagctcgagaagaccatggggtcacttgggctacatgagaaaatgccccagtgtgctggttcatcattccgactcctgcctgtctcttcccgtccaaggaacatggaccctaactcgtgcagttccagatgactatgggcagaattaggggccgtggcccaaaagttcaccgacatgggggttccacagaaggtgaggtggatctttgcaaatccagagaaatgacaataggacccagggaattagagcctcacaggcgtccgggagacttttcaggtataatgtctggtgtcgcaagacgagctgaaaagggagccaggcactgaaagacaaagcggtgttgactttcttcatctgtgtttcccaaagcagtccaattcactttggtagaattcatgtatttattttccgttggcttgtagttgcaaacttttgatgttattgatttttggttggagagtttcggtttgaaaaagtagatattctgaatatggaggttgtccaagattgtatctcaaggtgagtctacttgattccagcgaaccatactttgacatataatacatatgttttaattatattttgtctgttttaaaacagcttaaaaaatcacttcgtggaaaatgtcacttagatacaccaatgttaactttctcatcacatgtccagaggcactgtaaaattcattctagaatgcaaaattcccagccacttctacgtggaactttctgcagaatgggattgtatccagttttcagggggcgcaggtgtggtacgagctggtccttggtttcctgctgaagttggaatcctgcagattgcttaggggcggtttccacctgtcccttctttccaggtcatcactaacctttcctgatcccccatggggactcagaacttatctagagtcacaggcccacctgggatgctgcccttgagcctctgtgctgtccatgatggttccatgccactgatctgctgggacacattctgcagagggatgggcttgcatgagctgtccctgcctttctgaaaatcacagagatttctggtgtctgaagccacatagaaatatctgtggagtctcgggaaggccagggatgccattcacaggctgctgttcttcctcttaatggcagcaagagtgatttctgagtttcctaattgacttcgaaataattttgttgattttgttgtgacaaagaccactcctctttctgtggcatccagttcacctgtagggttttttgggattatgtggaaactcttgcatttttccagagcctcaattcatcctggatgttctcaggaatgcactagctgatccctgccttggtggcatcttgaaacattgagggaggccccttaggtccatgaggcacaaggaggtccatcaggaattgagggggcatgtgtctgcccatctgtagctggaacttccatttgccttcagaatgcaggttcttcctgaactaataaattatcttcatcttggtgtaagtagccacaatataataattcatagtaactctattaataaaaataactgaatatcaacaatgaaggtaataatgacaatgttaattattataatattaatagtaaaaataaaacaaaggcaatatagattacggattcccctaagtgaaggacaatgtccagatatagggacacatgtgtcgtttgcactcagagtcaaatgaaacgtgttcctcaaaggcaaaggacaagcagcataaggaaaacacaacgttcatggatgatcacatgggctaccttggaactcatgtggaaagactgcaggcaaagtgtatctggtactgggactgctcaccag

SEQ ID NO: 38 - DNA, 5001 bp, Homo sapiens
gccagcccccacccaccttcatgaggtaggacagcaggataatggggaaggggtccatgcaagggatgcaaggctcgtgtcacacctgattcaaagaagcactgcttctgacagatgtttatctcctaacactgtgtcacctctaactgcctggctgcatgtctgccatctgttcttcttaggtcacaggagggacagacattactgtccacctatctgcatacagagccattggaggctattacccttgttgcttcctctttggaaaggggcaacatacatgccagatgccattctctgtctctttggaaaactttgtcagcacatttaaggttttcttcagccacagaaagccacctgcttcaaagtctcatcctccacaagtggcaagcacacaatcattaatggaggcaaggggtacataggctttgccatttgattcagttgggacaataggggaggacttcttagctctacagctctgtccgtgtggccagctgacaatgtcaggctgcactgcgattagacttgtccctttgcacataaggcttccctccaatcctttccacagatgtggatcctcacatcacttcctaatatacatcctgcacactaaacttcatctatatccagttccctgggaaccaaacctgtgacaaaagtgaaaagtttctagggaaaatagggtttcctcatcagacaggaatcaaatgctgctgagctagaaaataaagtaaagtctgatgccatctcctgatttttttaattaggacattagcactgccagcaagaattatgtgcatcaatttgtggggacaaacatcatgttggagtgggatgaggttgctgtgagttgaggagaaatgctggtgaatggactttaccctcaacttggattcaggagaggacataaaaacagctggaaataaaaggtgtccgaaaacatttttctggtttttcaaaacttccaatttcaggttgggagacactatgtttaaattctaaagggatgtagcatgctgagaagaaataactataaacaaggtgtccattttatgaataatacaatttatggtatgacagaagaccaagggacataacacaaatttggagttaaagaaattaacagacattctcaataattcctcagctattatggcagagatgctgggacaatggatgtccatgtagcagtacttttttttttttttttttttttttgggagacggagtctcactctgtaaccaggctgccctgcaatggcgcaatcttggctcaccgcaacctctgcctcccgggttcaagcaatcctcctgcctcagcctcccgagtagctgggactacaggcacacactaccacactcagctaatttttgtatttttagtacagatgggttttcaccatgttggctaggatggtctcagtttcctgatctcgtgatctgcctgctttggcctcccaaagggttgggattacaggtgtgagccaccatggttggcccttgtagcagtacttttgaacttaatggctgaaagtatccacctccaaacttacatattatatctgcaaaagagtacaaaccatgtgatgaatttcaaagggaagacaagcctgtgggaattcaacagccatggcaatgctttgaacttctttttcttaaacatgtaagaagtaagtgaagttcaagacctaacagaattgccaggaattatttgaggaattaccaagatgaccatagacactatgaaatccttacgatgccctctgctggagtttcctcctacagccagcgattttaagccagaagaaaatgtctctgcaggcataagagttcaacccaaatgtactattcaattttaaatgtgatgacaataaaattatgtgctatatagcaacaactttttttttctttcagacagagtctttctctgttgcctaggctggaatgcagtggggcactcttggctcactgcaatctctgcctcctgtgttcaagtgattttcccacctttttcacaatgtatccttatcctcaaactcatcctcctaagtagctgggattataggcatgtgccaccatgtctggctgatttttgtatcagcaaaattatttctggggtggagagttaggaatcttttttctcccacacccaaaaacatgttgtccaaatgatctgtcaatagaaataattgatacctatatttgctaacctacctttttctttctttaaattcagaactagagtatagaaaaggatattaagaaggttctcttaattttcaacacaagttatgggctaggcactgtgctaggtgctacagatacgcactaatatacccacaatagttttgccttattgccttctatgttctaataatacaccaaaagaaaagtatagattagctttttatttttttgagatggaggttaattctctcacccaggatggaatgcagaggtgggatcttggctcactgcactttctgcctcctgggttcaagtgattctcctgcctcagcctcctgagtagctgggattacaggcacgtgccacgatacccagaaaatttttgtatttttcagaaagacagctttcatcatgttggccaggcaggtctcaaacccctggcctcaagtgatccacccatcttggccttccaaactgctgggattacaggcatgagccataatgcccagccacagagaatagctttaaatagaatgtatgaaaccaaaagaaacgtatgctcatcaattttatactgtatttggccaggtgcagaatatcgacttgtagtaatgtaagggaataaggtcaattcacatctaattgtttggacaagtcaccagaaatcaaaagttggaggagttgtatcttttgaggtgggttgcacaggcaagcagcaagttgctatctctccaaagtcctaaactgttctatttgtcctactgtggaaaaatgagtcttcaacttgatttcaatttatataggaaaatgcttaataaaactaataagggctacattccaggacacagccagaccacacatatactgaaacttgattctagagacacctcctcttcaatgtaattggattttcaagacaacaaaaatataactctgacacaatattggagagccaaaaggaaaggacaatttgggttgaaattttttcttttaaaaatgtgtccttgagttctattaacaatagctaaagcctaggaacagctcaaatgtctattgagaggaaattgataaattatatgcatattatagagtaatatttagcaataaaggggaaaaatcaactctatgaatcaacatcatgatcatggatcaatataatctttctaaccccgattggggaaagctaagctaaaaagtgtcctataatataaataaatgtatacaaaattctagaacagacaaacctaatataagctaaaaaagttcaggaaagtcaggtgcagtggctcatgcctgttatgtcagcactttgtgaggtgggtggatcgcatgaacccaggagttcaagaccagcctggccaacatgttgaagctaccccatctttaccaaaaatacaaaagttagcccagtatggtgtggtacacaggaacagaaaaccaaatactacatattctcatgtataagtgagagctaaacattgggttatacactgtttagctctcacttatatggaaacaacagacactggagattcttagagagaggagggagggttgggtgcaaggcctgaaaaactaactattgggtattatgttcactaagtgtgtgatgagatcattcatactgtaaacctcagcagcacacaatacatccatgtaacaaacctgcacatgtatcctctgtgtctaaaataaaaattgaaaaagtaaaaaatgaacaaagatatatgagcaggcatttctcgaaaaaggagatacaaatggacaacatatatataaacaattcttaccctctctagtcatcacgggaatgcaaatgaaaactaccaagaaatatcacctcacacctgttagaatagctattatcaaaaagatggatgataacaagtgttggtaaggatgtggagaaaagggaacctttgtatactggtggtgggaatgtaaattagtatggccaccttggaaaacagtatggacgtttctcaaaaaattaacaataaaaataccattttgttccagcaatcccacttattttatatataatatatatatctatatatatacatatatagatatatagatatatatatatgaagtcacgaaatcagtatgtgaaagagttatctgcgctcctatgctcctttcagcactgctcacaatagtcaagatctatgaagaagacatacatgttatcattcattcatggacggctgaattattgttttatatatatatatatatatatatatgtacaatggaatattattcagtattatataataatgaaaccctgtcatttgtgacaacattgatggatctgaaaggcatgaagtcatgtgaaataaaccaaacacagaatgacaaatactgtatgattccccttgtatttgaaatctcaaaaaaacaaactcagaagcagagggtagactgaccaagaactgtggtgcaggtaagtgtgtaggtgtgattacagtacaaagttttagatatatcacataaataagttcaggaggtctaatttatagcatagtgcttatagctatgaatactgcattgcatacttaaaatataataggagggtgaattttatgttaattattcttaccaataaaaataataattagaatgggagggagaactttgggaggtgatgaatatgtttataatcttgatggtagtgatgctttcacaatgtatccttattctcaaactcactgagatatacacattaaataggtacagctttttgaatgtaatcatgtctcaacaaagtgtttttaaggggggttggttaaaaaatttaaaaaggaa

SEQ ID NO: 39 - DNA, 5001 bp, Homo sapiens
agggtagatgttcctttgcccttctctcatggatttttctccctgctgtctagagttcaggaataataggtgggaatttagcagccaaactaggaccttttctaaagtatagcagagcagagagccggaagggacctgcatccctaatgatattagaaagtatctgtactagccctgaatggtataactacaggttaattttaagtgaaaaagaaatcaacttctgctttgcttaagcaaacttattcaggcattaattttataaacatgtagagaatatatactccttatgagcagaaacaatgtttgtgccatatggtacatgatgggtgttcaataatgtgtgatgatgataataatgaacacaatagtgatacataaaagaaaataaaaagcagtgaaacaaagtggtttaataaagatacatagttattttgttgaaagattctgctgctaatattattcaatacttttgtatgctggtgcaagtaaggaaatttacattgtctaataaaaattatttatcaatttataaaacagtaaatatttcatagaatggggctatgaatctgcattgcaaactaacactttcagttgattttatgcacagtaattattgagaatccccttatctagatccaacggatctggacctacataggtgctaccaaaacttaaggaagaaaattttcctgactctatccatacctccagttagtaatacatctagagatttagaactgaaatccagacatcctgcttccatgtgcagtgacctttcactgtcctgttttgcttcacttgatgaagaggatttgagaataaatgaccacatgattcaactcctcctcagctctgaggaatatagccctgtcctggcaaacaagaagctcctgcagtagtagagggggcaaatatatgttcactaatctaacatacaaggcagtaggcactgtaccataaacaaggcactgtggggattcagaccaggggcaaagtggggattaatagggcaagtaaagtctgggaagtgttcactaacaaaatgtctaatcattaaactaaacggtttctcaacatggcctaattaattgtaacaatataaatggttgtttgttcataaaccttaatcttttgccaaaatatttgtagcttatgttcccatttaacaaggttttctggtcaaaactgtgcacccacatcattctaatgaacttagtgtccaataaaacatggactctcagtcgtctcatgaaggtcattttgtgtgcatagtacatctctgtgaatatgcctaatgaggtatggaaggacacttattatccaaacaaagacattccactggtgctagagagccacagacggaagttttctctgcctactggaaataaagccaagctttcttctttcctcagccatgaggattgctgtcttcctctttatcattctgtctttttttttttttttatgagccaagctccaccaaataacaggataaactttgtgtaaggcttggtaagagtagagtgtctgacacattatggtgctataatactcaaagcaaaagcaaaatcgcctatgaccagaaaagggagtcacataggaaatctagaagacctattggctgagagacctgcagcctcatagttcattagctctccatagcaactctcacatgaaatgaagtcagtggtgtttcaagtgcttgaaaccctctttactctacttctaaatgtgaattaattaggcaagtttactagcagttactagacctcaaaagcaaaataatcaggcattattctactaaatattggtctccataactcctctattttcttttggaaaagttagttagtctaagacatttggcataaaggctatgccaaagctttggtggggtcagccaggaaggattcgtggggcctccttgaaaatattgcaattatctaagaaattttcaacctattgcccctcagtactgttggtcccctgtacttgacttttccccttaagtttgattccatttcctaacattatccttccctcttcctcctcagcaactagtcttctaaattagaacttaaacacaatgaccagatatgaccctgcaacagagcatgcccttctgcattgagcatgcaatcatgaatcacaggtataagaccccttgaacagacatggttttggtgattctgtgtaggacttattgcttttacccaagaagatgatcaggcatcctaagtagatcagaaaattttctggagctcttgaacttgtataggcaagaaagattaagcaacatgttgccttatatgaggcaaactatcttctcatattttcttttgaattcaggatttcaaggttggggaaggagtgggaaagtagccatggacgtgtaagaatgcggatcgtccttttacattgtcagggatggtcaaattctatgctttatgttgtttgctaaaagacactttccaaagttttcaacagaaaatatgatggcacacatgcctattcttggtgaacccagacttttctatctagtctgtgatagtaaatttaaaaggactgcttagggtaaatgaatccttcaagttataaagatgaagggcagtttttggacaattcccattttgctgtaggaaaactaatctggaagaagtaaaagggaaagattgaaatggagataatggagatggagaatgagttcagttgatcaaatttttgttaagcgcccactgtatgtggggcccttacaaggaaacaagcagacaaagaaaaaaagcatgtgatggccttgctcctaagaagccagaggccagtcacctggattgctacataccaggaagacgtcaacaagcccctacaatacagcacttgcataggatgaagaagaggtttctttgtatgagataaatagcacacaaccaaaaaaaaaaagccaaaagatacacaaggttcgaaaacctaagtcaccaacccttaagagatctgattgttggtggtgactttggaaggaaaattattattaggattattttagtactaagagttttgagctgtctatccaagattgtcatctgcacctctgccttaggtaatactgtgtgtgtgtgtgtgtgtgtgtgcatgtgcgtgcctttgcatgtgtttgaaatatattctgtatcccacactccacataggtttggggctgatctgaaactatactcttagggatggggttaagctactctgtcacattgtgaagagttgatatgtaagagactcttaaccttttataaattacctttaaaatgtttccttttctgtgaagggaagaataacaatttgtaaacaaatgcaaaaatatctttaactaaacaaaagaacagtttgttagccttgttatgattagcagagaggatagctgcagacactgtaaaatcactcagcaacaagatttgacaaaaccttaaatatgggtctatttttcctgttttatagaggaaaatattaaggctctgggaactgaagtgcttttcccaacagtggagtaagtgtcagagtcaaggctgggttttacatcccagctttccctatatattccaccctatggttctgttgtgctgttcctttgtgtgactccgtaaagcctgcttaaaagtgatatcatatcaaattgtattaactcagtagcacataacaccagggaattgatttataagatttttattcttgtggcgttgctgaagacccatctgattagtagttatcaagtagtcatcctggctaaatatatgggtttgatttttaattttgaaaatgaaaaatattttaaaatatatgtcttacatccatatcccaggaaattctaatcaagttttaaaactttcaaatttagataaactaatggttttttgttttaattttctctcaatgaaaatagaagaaactaattggatagaacagcacagcagaagcattacttatagccataaatgggataaaacaagactgaagaagaaaatgcaagacagtgcttaaaaaagcagtctaatgaaaagtgaggtctcctctggatgtccttaggtagacactgcagcagaactgtaaagtttttctggaagtctggggaagagaggaggaaacagagaaggggcaagaggagaaaatagaatgaggctcagaataccaagccttagtgctgtccctatcgccttcctcgctagatcactgggtgatcctgggcaagtttcttcctttccctcagcttatttcctcatctgtaatgtaagtgactagacaagatagcctatgatgttcattgtaactctaacttttccttcccaaagcaaatagctggaaaagacactgtgcttacaatatgcaacaaataaaaacaaaagatttttaaaaacccctagtgtaacttgaattcttacaaataagcaatggtacatcataattttacaaagctcttttgtgatttcatttttaaaatcaagtcaagttttattttacttcataataagataatggagataagtgttaaatgggttcatgaaggaatgtttgtaaaagatgcaataatccaaaataggtaattgttatattagtagttccctttacttgggtggggggggggaacagatagaagagtgttaggaaaagcttcataaagtggattatatagaatgtgctttaaaagagtttggtgttttactgagtggggaaagagcaatatggggagttattgttcaagggttaaagctataaaaaatgaatcaattacagagataggctccaaaccatagtacttatagttaacaataaggtattttgtatttaacaatttgttaagagggtcgatcttaggggttctgacaacaacaacaaccacaacaaagggacgtaggaaacatttggaggtgatggatatattattacctggatattggtgtggtaacaagataatacttatgtgcaaacttgccaaactatatccattaattatgtact

SEQ ID NO: 40 - DNA, 5001 bp, Homo sapiens
tttttgtgtataacaattttacttcagttcctactatattgcctggcaaacaatagatgtataaagtgagatcaatgattattgcatatgcatgtcaaaaataataaagaaagcaggtgacaataaagacatcctgaatctttgggaaataaatagcattcacctgctttctcatccattgagatatcaccacctttatgtacttatgtgtccctggaagtttcccgtgggagatttagttattctcttttcgttaggctctactgaccaagaacaaatcacagactcagagagcatcataaaaaggcctagacccacgatgcccagagactccaggctcaacccacattgatgctggcccttcagccatgagactccatttgcttctccttattctccttcttttttcaattctcttatccccaggtaagttggtagctcattactataaggttctgcagatgagaatgctatatccctggccagacaagaacctagaatcagtcctgtgggttcaagaacctaatatttacagcttcactaggattataatagggaaaaatagaaaagagactcatttagcagtatgtcctcttgataagattccatccatgtcttttgacctagtgagtggatataataatggatgctgctgaaattcaatcctgtcagatgaaactgcctacatgtaaatttccatgccccaccaagcacctcaagatacaaagtaaggatacaacagaacatgacctcaatgagatgcctttgcgggacatggaaatttatatgcaggcagttagatctgacaggattgaatttcggtggcatctattattatattcacttaataggtcaaaagagatggatggtatcctatcaataggagctactctaaatgggtgttgacaaatctgaaggttttattcgaagaaacagaaaaactataatcctagaataaatgaaaattatatgagagacttttcaaaataaattatgttttatgtggttatgaataaaaaatgattttcaaagtgcaactgaagagtagaaaggagagttaaaggaacttcagacaagtgaattaataaggagcaaagacaccaacaagtgctgctcaaggtatattacaggtaaccacacagaaatgggtaacataactttcaatacaaaaatggctaaaatttactgggctaagcatgcattttgggggcttttggaaaaaaaaaacagcataataaacctaaagaagataaagggaaaattataaatacaaaatataaattaatgaaacaaatgagaaaaaacagtattttaaaaaatgtttttcaaaaagtctaatacactttataataacctggcaacactgaacaagagaaaatgagaacatgcttaaaataactattgcaggaatgaaaggttaatatcaaaacagatgtttcagagattcaaataatttttaaatttgtgtatattccgtcttcactgtgtacttggggattttcctgttgcagttcactatatcatgactgtgtcatcaattttgatgctagtaaattattaccatcagcatacaaatatgctgttgtttttctgatctaagaaaaagaatttccttgcttttcttctgatgccagctgtcctccccttttttgctctacttttcagcaaaacatcttagaatagttgtccatattctctgtcttcaattcctctcctctcattgtttcttaaatatatcccaatcaagctctcattgtttcttaaatatatcccaatcaggctctctccccctttttcgatcatgctattgacaccacttttgtcaaagttatgaataatctccacattgctagatccaatgatcatttttcactacaactttaatcgacctattagcagcatttgacacaaataatcacttccttcttcacagtatactttcttcatttggcttccaggacggctcattcacttgattctcagcctgtctcactggagctaccacttcggcttcctttgtttcttcctcatcttttgcttcacacctcctacaggagagctccagagctcagttcctggtcctcttctcttctccctcaccacacactctttggaggggctcagcaagtctcatccctttcaattctccttttggacctccttttgaactccaggcttataataaattatccaactgcataactggtatatctacttggacacttgatttcaaaagtaatatatatccaaaaccagactcacgattttccctcagaaacctctacatacacattttttctcttcttgcagagtgccatggtcagcattggagcctctcttagctttcctgtccactttcatcctcagcaagcctctatctctgcacctcaagaatctctcagggctcccatcccttgcccaacctcgggcagtagctgccacacactcagtgaaagaccagagaaactacttctctcagctaccggccctgccctgccttcagacctcatcatgcctctcttcttatgcacctgtgagaacagagagtgaaggggggattctctcagctccccaacccactccccagtaacacagggttttcctcgattctcacagtgagacctttaccttgctctgacctcaaattgcaccagttcctacatgcctgtccctcaaaagtgtctcaggtagttctcctgctctccatctgatcttacctaggagcacacaagataggtcatgaaaaaaccattagtggggccacacgcggtggctcacgcctgtaatcccagcactttgggaggccgaggccggcagatcacgaggtcagtggctaacacggtgaaaccctttctctactaaatacaaaaaattagccgggtgcggtggtacatgcctttagtcccagctactcgggaggctgaggcaggacaatcacttgaaccctggaggcggaggttgcggtgagccgagatcgtgccattgcactctagcctgggcgacagagtgagactccgtcaaaaaaaaaaaaaaaaagaagaagaagaataaagaaagaaagagaaagaaagaaaagaaaagcattaaatcattagtgagtgaatgagagtgagtgtgtttgggcccctactgatgctaaactatcacaagcccacactcagcctttcaacatttgcttgaggttcacttgtttccttcttatctccatcaagggcagcttcctcctgcttctgctgctgcaactcaggtacacacaaagcatgtgtggatccgttcttttttcagtagggcttcattactctgaatttaagttaattagctttttttaaagacttcagctctgtcttttaaaatgaaatctatgatctatagattatccagcttattcttttgtcagggcaagagcatttttctataactttctaaattctaaacaaaagtaaaagttcacttctttccagaatccccccatgtcagaaagtattactattatcatcagtttagtgatatttatggaattccaagttgactctgagatcagcttttgggttaaattctttcttcctgatatatagcctttgaaattttatttgctgcagatctcttggtagtgaacaattttagtttttatctgtcaattttgtattgttatttttgttcttgaaagacaacattactgagtacccaattctatattaacagttatgttctctcaacgtttgttgatactagtttattcatttttagtttgtgcttcactatgatattcagataaatattatttcattataaattgtccttttttcaatgtttgtatggtctggtgtttggttttaatattttataatttaactaatgtgaatttatttttatatcatctgttagaaatatattctttgaatcaatggatttatactttttcttaatttctttttgagaatctcttgaaatggtgaatcctcttacacttctcttcccgcatatttgaattaaataaatgttagaccttgtgtttccatgctacattctgggtatatcatttaagcatttttttctttactaattatcctgttacctatatctaatatatcattaataacttgcattaatttttaaaattttttaatttagaactgcattttggttttgttttgttttgtttttttggagacagagtctcactctgttgccgaggctggaatgcagtgttgcaatcttggctcactacaacctccacctcctgggttcaagtgattctcctgcctcagcctcctgagtagctgggactacaagtgtccaccaccatcttcagctaatatatatatatatatatacatttttttttagtagagacaagttttcaccatcttgggcatgctgttcttgaactcctgacctcgtgatccacccgcctcggcctcccaaagtgctgcaattacaggcatgagccaccatgcccagccagacctgcccattttttctatcatctatatagctttactattgtttttacatctttgtaatagtagattttttctttaaacaatcgatacacagctgcttaattatttctccacattgacaatttcaatacatttagttttcaaggatttaaatgtgctattcatttcattaacttttattcatggtttctttcttacctgatcatttttaatgatgaactcattgctcatccttaatctgccatcattctacagtctgaaataagaatgctattattcaaacttcctctgtgaaactgactcaatcctttatctcaatatagaagttccaggattaacgaactggaatttctgatggcccaagagtcagtagtaccaccattagcattgttgataatagcagatcttcccagaagatatgggaaaccctcacccacctccatcagctagccaatacaaagtgcctagtgctcaagctccagttcacagactgtttttgtgtttgaaagaggagatattttaagaacttgcctaacca

SEQ ID NO: 41 - DNA, 5001 bp, Homo sapiens
attttcaagaatagaaatgtttcaaagagatcgtctaaaatgtatttgttcgatagcagcagtcatttgagagcagctaacttgcagtcatggccaaaagcctaaatctttctttcattctaatcacacctattttatatattttggagatattaaagattcagatgtattcatactattctatgatttgggacactgctatagattcttcaaaatgttacaacattccagtggtattttgggaggtatagaaggtgagaggaaacaatgggctcaagtctcccctgacttctcttcttacaacatatttcattgtccaaaacttttagaactatatcaatacaacattgacagtggatattcttcttttccttctgattttaataggattgaaggaagtgcttgctatgaaattgctatatgggttgtaatcagacaaattttgactttgaaaacgcaatattcttctcattattttaaaatgtttaccaggattcacagtattattttcaattctccccgttcaaaggcatatttaaataacttgatgaaagggcaatattatatatgttactctgctatggaaacagaaaaaaccaccaccaaattgtattctagatactttgtacaccaattgcaccatctttttttatctaagacattcagttcttccacaggtgggagcacatgaattagcatcatttagtacttgtagttttcactacagactttcagacttatggtgcctaaaggaaatagaatgcttctagctgggtttaaaagctacaaataaacagaggaaatatacactattttgaaagtaccacttgagcgttctgtatgtatttcaatattatgttgctaattttaattgttcaaggttaaggagcttaaacctcctcctcatgcattcctgaatcatccattactcgcacacatacattgtttgatacagcataaacctaagtaagtaaagatgtggcaaaatgaaaaaaaaataaaataatgtgataccattcttatctaggaatggcatcagtagacagatgtgaataaaagtaatgtgattataattttaaaaatcatatttaataggatccatttattattaaataaacattaaattacttaatgtataataaacccttaacacgatgacaactcttaatgcagagtgagaccaaaatgaaggtattaactattttcttcctaatccttgctttagttgttctttccaccagactgtcactttattcgaaggatattgtaatagcacaaagccatcagctttaccattagagagatcttcattaaattatctttgttgtaataaaggtcatctggaggaaatactggtctgaatacaataataaatgttaagctttctagtattttccacttttagacacaaattgaaagaatcatttataatgtcaaaaacacttttttctaactaatctattctatgactaagacactattagcaattaaagtagatagatcaaatctaaatatggagagaaaaagtaatttctacttatgtttaaacaggtgaaaccacgaataaattgaaagcctgaaatattagcttaggggaataatgtcactttcggggagcaggagcagcatataccagcctttagctctacacactcccccaaagaaaaaaaatatatagatagttatgtacaaaccaaaatagcactgggagggttcaagggaccatttaagaaactatggcaacacagtgaagccaacaaaaaaaaaaaaaaagagagagagagagagagagtgaaagaaaaaaaaaatagccatatagaaaaaacagctgctgaaatcagcatacctgagatgccagaaacatcttttttggctagaaacaaaagcagaaagggactatctgtatcagccacaaggtggaagcaccagggccctcagtaacccactctggcagaagacactggcattttttgccactggagtaagcaacatccctttctgacagaaaacccagagaaaaagatgaagaggtaccatctcctcccacatcccttttccccaccaaaaatgcagtgactgttgggccaaaccaggattggaactgctacctttcttaaactgcatgtgtctctgacatatgagcagcaaccatgtcaagagctcccacataaaaacgttcatactaaatttattctgttacttaagagtgtttatggatttacattccatttgtggactaactatctcactggatcttctttccttcagtaagaggtggtttgggtcctgcggaaggtcattgtctcaatttgtttggtgtttgcagaacagatgtctgcaacatagtagaagatcaaattggtgcctgccgaagaaggatgaagtgctgtagagcatggtggattttaatgccaattccaacaccacttatcatgtcagattatcaagaaccccttaaacctaacttgaaatgaaactgaaacaaaataaaaatacatcaaaagtgaagttatttgcatctaagaatattaaaatatacatattaagtacttccatcttgataaccgtcttgcattttcacttatcaacataaatgaataaatactaatttcaaatacacccaagtactatttctttgtgaatcattaacatatcttaacaaaacttttaaaaatgagaaaactgttacttttgttttccaagatggtggattgaaggcattgttagtctgcctcttgcacttggaaagagaaattggtgtgtagagactcacactgtgaactttctttcaagaagcaacacaggaatttaacaggaaaattgaaataagccacagaccatttgaaagaaacagcaggatgcagcttacaccataagctaggcagaaaattgtaagtttccagggtgtgacaggagggtaactgactctaagatatacgcttccactgggaaacctatcaatccaggccgtgagggaaggccttaaccctcctcagcgctggagctgatttagggaagagtggtgagtatatgaggagtggcattgggatgtgctttgaatctccagcacattcccagtttctggtagaatggagggaagccattgctgattctacctcagacaggacctcctagaagtctgccaggtaactcagatggttgtcacaggttgagacaacctcccaaatgaaatgtgtgatataatcttgactggggacaaactccccaggccagaactgagaggtgagtgggaagtgtgctgcagcagcaagcacaggagctgggggcccctgctctgcaggtggatcaggaagggtgtggcctgaaggttgcagttgctgtctccataggggagacttatggtatgggtcagttttgagttctgagcccagacttcttgaagcttagctagctactcccattggaacactgtgggtgtgagacctgccttgccaagtgtgtgggagctggatggggcttactaccaagctgctactccccattcttcacatagactctccttgtacagaggcagtgacagtttcacttctctctggaaaattactccagtggcccaagaacagccttccaattcccactggagccactgcttgtcccacacatagacagccagagcatcaccttacctgacctagttcccacctggctttgctcaaccacctaccctggtagattaacacaaataactgaagaaacttttagaagctctttggctccacttatttcctgagacaccagagtgcctccaatgggtaacataaggcaagtccaaatctcaccactaccaccacagctggcagtcttttggaagcaccacctcctggctgaaggcctactgacagtcctttacagcatctgcaggtagaataacatagcacccaggaaggagaaaagttgtgagtgaccacaacttttaccattgcttgcatcattctggctaagcaggaggccctgagtctgtccatgtgatgagttcattactactacaactggcatttgagaaatccaatacacaacacactaggactatttataaccaaggaatctttcagagtctacaacactcccctgccatccccatctgatcagctgctgatacacactgctgtgagacgtgaggacaaattatatcactggatccattgcagacattcttgagcaccagcctggtgtgcggcatccccactgggtagctagacccagagaagcagcagcagcatatgcagtaatctgaatttcatggcctcctactctgaggaaagaggaagcacaccacatcaagggagcaccctggggacaaaataatctagatggccttgagtcccagaacattccacttgtgggaagttgtttggtggtttgtttgtttttgtttttatttccagcagaggaacatgtgcatgctaggctcagcgaggaaagtctgtagctatatctcaacaatcaggcagccttgatgctcaagaagagtcttggagaatggggacttattttccatctcatacactactgcagacacaatagtactgtactcagagccagtgtactgaggtgagtggccataaaacctactgagacaccagccaggagagctaaaggagtacttgcattaccactcccccaaccccaggcagcacagcttgcagctccaaaaaagaccgcttccttctgctagaggagattagaggaaagagtaaaaaggactttgtcttgcatcttggatatcagttgagccacagtaggatagggccctggtcagggtcatgaggtccccactgtggatgtaactaactttttttttttaattttataggctgataggcagaagggacttgtctcaaataagactttggacttggagttttgagttatgctggaaacagttaagactttgggggactgttgggaaagcatgattggttttgaaatatatataaaatacatgagatttgggaggtgccaggagcagaataatatggt

SEQ ID NO: 42 - DNA, 5001 bp, Homo sapiens
tttggctctgtgtccccacccaaacctcatctcaaattattatccccacacatcgacagagggacttgtaatcgccatgtgtcaaagaagtttacttcatgctatactcatgatagtgagtgaattcttaggagatctgatggttttaaaagtaggaggttttttttttctgtgcactcacttctctctcctgccaccttgtgaaaaaaggtgcctgcttctgtcttgccttccaccatgactgtaagtttcctgaggcctccccagcgatgcagaactgtgaattaattaaacaccttccctttgtaaattacccagtgtggggtagtgtctttacaacagtgtaaaaatggactaatacaggttccctgaaatattctgagtccctttggaggcaagaatctctttataccagcatggtatactgatgaagtacatcctgatctcatgggctaagaaagaatttatacataccctttatgtgtcagcaactctatgtgcaggcttttgagacccagaatgggctttcttgccccatctagtctatgtaacatttttctaagccaactcaatgtctttcatccacactgggataggtcctaaattgctgtctgttgcccacctgagataatgacatgttgttaaatcaggtgtgtgtgaccctgatacgtctatctgagtggcaggagagggtctatctgttcacaagagtctctgcaacattttctaagtcagttcagaagcttattgattcacctttgcaggcaatgtagccatgagaaaggtctccaaaaattcctgaccttctggaaatttttaaagtctccgcaggtttccagaggtgactgtagctgcactgaaagtcactgcctggataactggcctgttaaagcaaaggcaaaatatgtcaagcccactaagaatacccagaagccatggtattcaattaatttttgtctttcttgcaggtgggagaatactgaggattatgccctcctatagccagtgaaggttactccagtgcctagatgtaccagtcaagagaggtcatgggagagcagatggcagaaagggcagccaggtcctttcgctggggtttactgcttgtcatgagctctgctgctgggcagcatgtgtgatttctgactcctgccatgtcctcaagaagccttgccccatcagccagctgtcctacctcctgaaagctggtgcatgtttgttaacatggagatccagaacaagagtcactttagtatttatccatagagtccccatgtgtgcacatgcttacctgcaggttgtttttcctatttttctgaatgttaatccttgccttctggaactcgatattaccccctgtggccaaatatgggataattgtaaggggaaactgctctttaggtcccaagtccacagggttagtactattatcaatattaaaattattaattatggatattagtatcataataatcatcatcattcctgttaatactcatcaatatgtttattattattatcattaagatggtttattaatgttattattcagtaataaatgtttagtttctccattcactcagtcaaactggagtctgactcccgatatgactatggatatgactgcatatgactatgagtgttaccctgcagatatagacatgaaccgctgtcccagagacagctcttgcaggcactaattgctctttcataggatgagttccttacaggagagaagggctgatctccatgatgtggtttcctcagggtctcattaagggctggtgatacaggagcactgcctacccctcttactcacgtgagagtggtacattctctgttgtcatggctgggatggctccatgttgaacatataaattccaggttctagaagcaaaaaagcaaaagatgcattggatctgcatagggaactgcaagccatccagcaaccacaggacacagtcagaaacaaccacgtggaccacatcgcccaagctcagctgcatggctctccattgggttaggacgaggacctattccaccaggctcaactggagtcctatccctggtcccaggaccacaaggagcatctctttttttggaatcacactgctccattcgaaggacagccctcagttctctatcttcaaaagaggctgcaaatggtgctgattgggagggagccaccagcagcatcaccctctacaactataaaataaaactgtctcccagggtgggatattatgctgaccctacctaaaagcacatttcctagatgttgcttgttgcctggagtttgaacagcattgtccaaactttgccattgaagaacaaggaaacttacctggggtagttgcaggagtaggcctaaatccaggtgtgaagatccttgaactgggggtgtttctgtacctgtagagattgcagactgggaaaggtaaggctctggtcctgccaggctctctagaggttaagaatgtgatctgcagaaagacatgaactagcacaggctactgtagaacatctgcccccaagaatcataaatgccttttcactcatcctgcagaatgcactctctactttaatgatcgtgtgggatgtgactttaatttttaggcatggggattgatcttaagaaaaagcaggcaaagtgccttacctgtcctgggactctgctccacttgccaacatttgagtggattcatttgtgtggtagtcaagctacaggaaataaagggaccagtcagtcttccacacaatgacacagaggccaattatcacaagtccaaatctccatttgtcatccagctcacattcccgctgtggcacaaggtcacatgcactcgtgtccaactccaaatagtagcttcacgtagtatgccagcactctcccacccatcacctcttctagaaggtcttccgctggattggaaatggcctgggataaaagataatgaccacaggaagcagttgtttttttaggatctgatccacatgagaaggtaggacatctaatttggtctgaggactttagctatgctaatatttcaggtaactgtcccctgtgtctatagatttacaatgggaatggagtgagagatgatgaaaactgttttctttcctagtgagtatgaggtagaacccttacatcatgctctctgttacctgttctccatacagagccatctcccatttagagagaagacatggattgtcagtgggagcaagcctgagatatgcccactggcagctcccagaaacccctgaaacctggccacatcatgaagtttcaactgtgggtctcatgcctctcttggtatcttgaattcagaacatttaatgtcatggcaggccagggaacttcctctgctctagtttggctctctatcgcacattcaccgcccccccaccccccgccacacacacacaaagtcacacacactcacacatcaacctactggcaaaccaaggtagaaacacacacacacacacacacctgctcaatccaggccaatatccctgatgaacattaatgcaaaaattcttaataaaatactagcaaacagaatccagcagcacatcaaaaagcttatccaccacaatcaagtcggctgcatctttgggatgaaatgctggttcaacatacacaaatgaataaatgtaattgatcacataaacagaaccaaagacaaaaaccagacaattatttcaatagatgcaaaaatgcctttgataaaattcaccatcccttcatgttaaaaactctcaatagactaggtactgatggaacatattgcaaaataataagagctgtttataacaaacccacagcccacatcatattgaataggcaaaagctggaaacattccctttgaaaactggtacaagacaaggatgtcctctgtaacctcttctattcaacatagtattggaagttatcaccagggctatcaggcaagagaaggaaataaagggtattcaaataggaagagagtaagtgaagttgtctctgtttgcagatgacatgactttatatttagaaaaccccatcatctcaattcaaaaacttcttgaactggtaagcaagttcaccaagttctcaagatattaaatcattgtgcaaaaatcacaagcattcctttacatcaacaatagtcaagcagagagccagatcaagaatgaactcccattcacaattgctacaaagagaataaaatacctagggatacagctaggagtacaagggatgtgaaggacctcttcaaggacaactgcaaaccactgctcaaggaaataagagaggacacaaatgaatggaaaaacatttcatcctcatgaataggaagaatcaatattgtgaaaatggccatactgcccaaactaatttatagattcaatgctgtacccatcaagctaccattgacatttttcacagaattagaaagaactattttaaatttcatatgaaatcaaagaataccccgtatacccaagacaattgtaagcaaaaacaacaaagctggaggcatgacgctacctaacttcaaaccacactagaaggctacagtaaccaaaacagcatgctactgctgccaaaacagacatatagaccaatggagcagaacaaagccctcagaagtaacaccacacatctacgaccatctgatctttgacaaacctgacaaaaacaggcaagggagaaaggatctcctattcagtaaatgctgctgggaaaactggcttgccataggcagaaaaccaaaactggaccccttccttacatcttatacaaaaattaactcaagatggattaaagacttaaatgtaaaatccaaaaccataaaaaccctagaagaaaacttaagcaataccattcaggacataggcatgggcaaagacttcatgacaaaaatgccaaaagcaattgcaacaaaagccaaaattgacaaattggatctaattaaactaaagaccttctgcacagcaaagaaactatcatc

SEQ ID NO: 43 - DNA, 5001 bp, Homo sapiens
cagcatgaaaaagcaacctacagaatgggagaaaattgttgcaatctgcccatctgacaaaggtctaataaccaaagttgacaaggaacttaaacatatttacaagcaaaaaaacaaacaaccccatcaaaagtgagcaaaagatatgaacagaaacttatcaaaaggagacatttatgcaaccaacaaatatatttttaaaaagctcaacaacactgatcatcagagaaatgaaaatcaaaattacagtgagataccatctcacacccgtcagaatggcgattattaaaaaattaagaaacaatagatgctggtgaggctgagaagaaagaggaaggtttttacactgttggtgaaactgtaaattagttcaaccattgtggaagacagtatggctattcctcaaggatctagaaccagaaataccatttgacccagcaatcccattactggctatgtacccaaaggaatataaatcattccactataaagacacatgcacacatatgtttactgcagcactatatacaataggaaagacatgaaaccaacccaaatgcccttcagtgctagactggataggaacaacacacaacacagcccgttgggggctgggggtgagggaaggaaacttacaggataagtcaataggtgcaacgaaccaccatagcaaaggatacctttataacaaatctgctcgttctgcacatgtatcctgtattttttaaatttaaaaagaggaaatacatacatacatacatacatgcatacatacatacgtatgtacatacttttgaaaaacgtctatacagcttggatcttcattcctgataagccaaggaacctggagaaacaccagaattctgtccctctgagaatgccggacaggtttaccttcatcaccataaaattttggaacaaatgtggtaactgcaggttctccccacaatgagtaactgaaaattgaggcagtatttcagatcctaaaaaactgatgaagtaattcgccacacatttgggttgtttttgccttttcctactatgaagattgctaataggaagaatagtgtacaagtatctgtttgattccctgcttttagaatcctttgcttgtttgtgtgtttgtctgttccttcttgagacaggatgtcactccagtcagccaggattttccagtttgtaatttttgttgtttccttttgtcaagttttagaagttgttattttatttctattgaattttaaggcatttttagatatgtattaaaacattatcacacaggccgtgtgttacattgcaattattttcatcattcctttaagaaacaaaagatttagcttagatatcttccaatttgtgaatcttttctgattttgacttttttaaaaatgctgtcatatacaagaaacccttggattaaaaatgccatgaatatttctcttttcttgcagtcataacttcggtgtatgtcatcaattagtctctggtttatagcatgttttcttgaaagtgtttcacaatgtattttgggcattgagaatttcatcaaacttaagtgaaggtttcgacattcactattgaagggaatagtcctatttgatgccttattatttgcatatcttgcttccacaagaacacttcacgcaaagacttgtcttctccccaatgccagatcattacaacatgacatggaatcaactggccaaaaatgggaaggttatctctggaatgtctatttgactccattgatcacttcatcttaattaagacaaaaaatatgctgtgttaattacctcacattgttgcaaattctcaagtcagaaaatgtagttataacttcttggcatttagtcactgaaagaatgatcttatctcacagatgcacatgcttggaagtacttctcaaggcatacacacacatccagaaacaaacacacaaatacactcatacacacaaactgtttaatatgtacacaattgttaaatagcattgttatacatgaaataaggcaaatgtttagctactatcctaacccggttccactcctaacatatttgctcataatactgacaagtaaatctgcttcaacccttccatagtcacaatgtaagcagtgtccattaaattctctgaggaatgcaagaggatacaacctaagacaaaaaacttaattgaatcctgatatttcattagtaaatagggtaattgatggataaatgtaatggtctcggtgggtggacagtagttaaataagggctgatgcagcaagataattatttaaaggcgtttgaaagaaattgaaacaggagagtggatgtattcagctaaaataaaatccggaagccctgaaataaatctcattttgcgggtaaaaaaatggcattggaggagattctgggtcaatcatgaagctgtgaaagttgcatcttggaagcaggatccctgtaatgaaacgagacttgtttatcagaggtggtctttcagaggaaaagattttgaagaatggccccttccttttgtgtatttgacgattagatttcatgccaaatttcgggttttaaactctatttaaacgttaaaagaattaactaaaatggcaaaaaaacaagaaattttttgattaggaatcgtcaaatattcatttcttgttagatacagttaccaaacacgacctaccggagagaaacaattgtggagaatggccccttatttttgtatatttgctgattagatttcatagtccatttctcattaggtacagagatcaaagttgacctacccaagagtagagatatccaggacagaactcagggcacggtagaaccacagaatcttgggtgaaatattgctcaagaacaaaaatgtgcttattcagcgtgtttctgtgtgacatgtgtggaaactaaagtgcaatgagcatgacacgaagacagaatatcaattcggctcacctcaaatcagttgtgagcattaaagaaaaccaattcctaggtcccgcttaaagagataagaccatccaacaacctgtgtgaagccaccgcatctggcttgctcatgattctggggatcattctccagaaaatggtggctcctttctccctgtggagcatctttctaagcagtgccctttcttcccccaggacactttacatgaggtgcaggaagccttctgatggagcacacctggcccatgaaaagacaagggaaagaaaaagggccaaaggtcacagtcctctcattacatcatcatccttaaaatcatcctaatttcatgagccctgaagacagggctgtttctttacacctagaggccttggcgccgggcctcaattctgccctgttccttactgtctaagacattttgggaaaatcactagagccaggaccttcattcctggtaagccagagagccgaaagacacacccaaattctgtccctcttagttcagggaacaggtctactttcgtcagcattacaatttttgcaccaaatgtgctaactgcaattccaccatacaatgcataactggaaatggagggaacatctcagatcatgaacaatcgatgagagaatccaggagatacacggcttatttttgccttttccctgtgaaacaagggcaagtattaaaaactttatgctgtcttctatttcactgcctgcttttaaacgtctccgatgtattcttcttgagaaagggcctcactactgtcacctgggcttttctaaggtataattttccttgtttgcttttgtcaaaattagaacattttatttcatatctatgaaatgttgatccattatcacatacgtatggaaatagtatcaccaatgctgtgagataagttgtttttattttggtcaattctttaataaacaaaagcttatagttgggataccttctgatttctcaaggtttttgtttcatgttttcttaaactgccgccgcacgtccgaaaccactcactatacaatgtcaggaccatctctcttttctggcacacataaatttggggaatgtcatcaattagtctctcggtgattgcatgatttccccaaagtctttcacagtctactttgtgcaatgagtatctcttcaaacttcagtgcatatttctaccatttgatgctttattatttggcaacctagcttccacaagagcatgtcaggcaaagagttctcttgttctccactggaaggtaatttcattcgcacagagaatcaataggctgaacgtagaaaggttatcgctggaagctctgtttcattccacggatctctcctttcttattaaagaaaaaaatacgctgtgctaaataccatacttcattgactaatctcaggtcagaaagcacacttccgatttcttgtccttctgtcgctgagaggatgatgatagctgccaaaagtacatacttggaagttcatcccagcacgagcacacacacacataaacacacacacacacacacacacacacacacacacacagacacacacagggtttcataggtaaagatttcttccctgacattcttttacctaaaataaggcaactgtgcggccactgcccaaacccggttacactcatattatatgtgcctatcaccctgaggagtaatttgattcaggtgttctagaagtcatgatgtgggctgtgtctgttgaattcccagcgatgcaaggggacacaccctgtgactcattccttaattgagtgctgatatttgattgttttatcgcgcacctgatgggtgggtggggtgttcgcggttggtgggggtgagttctataagggatgatgcggccagagagctcgtcatttgaagactctctcggaagagatagcgtcttgctgcaacctgcggtcccagcagaaaaaccttgtgatccttgttgcgggcgacatgggggacgactcactctacttgggaggtgagtggcagttcaaccacttttcaaaactcacatcttctcggccagatgcagcttttgctga

SEQ ID NO: 44 - DNA, 5001 bp, Homo sapiens
aaatccagcggacttctctccctgagaagtcaccactctcatctgagacccgtgtcgacctctgtgatgatttggctcctgtggcaagacagctcgctcccagggagaagcttcctctgagtagcaggagacctgctgcggtgggggctgggctccagaatatgggaaatacctgctacgagaacgcttccctgcagtgcctgacatacacactgccccttgccaactacatgctgtcccgggagcactctcaaacatgtcagcgtcccaagtgctgcatgctctgtactatgcaagctcacatcacatgggccctccacagtcctggccatgtcatccagccctcacaggcattggctgctggcttccatagaggcaagcaggaagatgtccatgaatttctcatgttcactgtggatgccatgaaaaaggcatgccttcccggccacaagcaggtagatcatcactgcaaggacaccaccctcatccaccaaatatttggaggctgctggagatctcaaatcaagtgtctccactgccacgggatttcagacacttttgacccttacctggacatcgccctggatatccaggcagctcagagtgtcaagcaagctttggaacagttggtgaagcccgaagaactcaatggagagaatgcctatcattgcggtctttgtctccagagggcgccggcctccaacacgttaactttacacacttctgccaaggtcctcatccttgtcttgaagagattctccgatgtcgcaggcaacaaacttgccaagaatgtgcaatatcctgagtgccttgacatgcagccatacatgtctcagcagaacacaggacctcttgtctatgtcctctatgctgtgctggtccacgctgggtggagttgtcacgacggacattacttctcctatgtcaaagctcaagaagtccagtggtataaaatggatgatgccgaggtcactgtctgtagcatcatttctgtcctgagtcaacaggcctatgtcctcttttacatccagaagagtgaatgggaaagacacagtgagagtgtgtcaagaggcagggaaccaagagccctcggcgctgaagacacagacaggcgagcaaagcaaggagagctcaagagagaccacccctgcctccaggcacccgagttggacgagcacttggtggaaagagccactcaggaaagcaccttagaccactggaaattcctgcaagagcaaaacaaaacgaagcctgagttcaacgtcggaaaagtcgaaggtaccctgcctcccaacgcacttgtgattcatcaatcaaaatacaagtgtgggatgaaaaaccatcatcctgaacagcaaagctccctgctaaacctctcttcgacgacccggacagatcaggagtccatgaacactggcacactcgcttctctgcaagggaggaccaggagagccaaagggaagaacaaacacagcaagagggctctgcttgtgtgccagtgatctcagtggaagtgccgacccacacgtaggggtgcacgcacacacacacacacacaaatacacccacaagcacgcacgcaaacacacacacacacacccccaaacaaacccgaacaccgtcaatcctacataaagtaatgaggagtccaagtttctgtctctacaacagggacaactggatagtgatggctgtatctcaggatgagcccacacatgggaaacatcaagttttggggtcgtgagtcttccgaacctctggagggactgtctgtgtgtttgtgttcatggtagatgacattcactgtgtatttctgaatatgacctactgacgtgtaggtttgcgtgtgaggttattgcaggggactcggtttcctattttctcttggggtgtgtttcattcgtcagttgttgggcggcacgggaaggtgaaattttgctcatgtggcacatccgtggatcattctcgccaccttgaatagtggaaactggaatgcatttagaagataggaacggtgctcttctttcttaccctggctcgccgtttttacattggtttctgaagggacctcaggcgccctgggacttgtgctcttgctggaacccacataacgccggaaacagacagaccgacttgcctgtttcacggggtccacttccaatgagtcgaaacggaaaattttcccactggcatgtcagtcatttggaactaagtcctattgataataaaggaaatcaaacacaggagtgtgtgtattcaactgaaataaattcagaaagccctgaaaaaaaatctcatttggtgtgcttacaaatggcatttggggagattccgggtcattcgtccagctgcgaaagctacacctctgaagcacagtccctgtccttcaatcagacttacgtatccgacgtggtgtttccgtggaaatgattgtgggaaatggccccttccttgtctgtatttgctgattagatttcatggtccctttctcgttaggtgcagtgatcaaagttgaccaaccccagaggaaagctgcccagggcaccactcagggctccgtagaaccacagaatcttgggcgcaaccctgctcaagcacccaaatgtgcatacgaacagggtctccgtgtgacgtgtgtgaaaactacagtgtgatgagcatgactcgcagacaggttatcgattgggctcccctcaaaatcagttaggaacatgaaagcacaccgatgcccaggtcccggctgcaggaataagaccctccgacgtcttgtgtgaagccacggcatctgcgttgctcatgcttctggggatcattctcctgaaaatggtggcttctttctccctgtggagcatctttctaagcagtgctcctttcttcccccaggacactttacatcaggcgcacgaagccttctgatggaccacacctggcccatgaaaagacaagggaaagaaacggggccaaaggtcacagtcctctcattccatcatcctccttaaaatcatccgaatttcatgggccctgaagccagggctgtttctttaaaactagaggccttggcgccgggcctcaattctgccctgttccttactgtctaagacattttgggaaaatccctagagccaggatcttcattcctggtaagccagagagcctgaagacacacccaaatgctgtccctcttagttcagggaacatgtccactttcgtcagcattacaatttttgcaccaaatgtgctaactgcaattccaccatacaatgcataactggaaatggagggaacatctcagatcatgaacaatcgatgcgagaatccaggagacacacggcttatttttgccttttccctgtgaaacaagggccagcagtaaaaaggttatgctatcttctgtttcactccctgcttttaaacgtctccgatgttttcttcttgagacagggcctcattcccgtcacccgggcttttctacggtataattttccttgtttgcttttgtcaaaattagaactttttatttcatctctatgaaatgttgagccattatcacatacgtgtggaaatagtatcacccatgctgtgagatacgttgttttgattttcatcagttctttaataaacaaaagcttatagttgggatacctttggatttctcaaggtttttgtttcatgttttcttaaactgccgccgcacgtccgaaaccactcactatacaatgtcaggaccatctctcttttctggcacacataaatttggggaatgtcatcaattagtctctcggtgattgcatgatttccccaaagtctttcacagtctactttgtgcgctgagtatctcttcaaacttcagtgcatgtttctaccatttgatgctttagtatttggcagcctagcttccacaagagcatttcatgcaaagacctgtcttgttctccactggccggtaatttcactcggatagagaatcaatagtctgaacgtggaaaggtcatcgctggaaggtctgttggattccacggatctctcctttattattaaggaaaaatatacgctgtgctaaatactatacttcattgactattctcaggtcagaaagtgcacttcagacttcttgtgcttccatcgctgagaggatgatgatagctgccaaaagtacatacttggaagttcatcccagcacaagcgcacacacacacacacacacacacacacacacacagagacacacacacggtttcatagataaagatttcttccctgacattcttttacctaaaataaggcaactgtgtggccactgtcccaacccggttacactcatattatatgtgcctatcaccctgaggagtaatttgattcaggtgttctagaagtcatgatgtgggctgtgtctgttgaattcccagcgatgcaaggggacacaccctgtgactcattccttaattgagtgctgatatttgattgttttatcgcgcacctgatgggtgggtggggtgttcccggctggtgggggtgagttctataagggatgatgcggccagagagctcgtcatttgaagactctctcggaagagatagcgtcttgctgcaacctgcggtcccagcagaaaaaccttgtgatccttgttgcgggcgacatgggggacgactcactctacttgggaggtgagtggcagttcaaccacttttcaaaactcacatcttctcggccagatgcagcttttgctgaaatccagcggacttctctccctgagaagtcaccactctcatctgagacccgtgtcgacctctgtgatgatttggctcctgtggcaagacagctcgctcccagggagaagcttcctctgagtagcaggagacctgctgcggtgggggctgggctccagaatatgggaaatacctgctacgagaacgcttccctgcagtgcctgacatacacactgccccttgccaactacatgctgtcccgggagcactctcaaacatgtcagcgtcccaagt

SEQ ID NO: 45 - DNA, 5001 bp, Homo sapiens
tgctgcatgctctgtactatgcaagctcacatcacatgggccctccacagtcctggccatgtcatccagccctcacaggcattggctgctggcttccatagaggcaagcaggaagatgtccatgaatttctcatgttcactgtggatgccatgaaaaaggcatgccttcccggccacaagcaggtagatcatcactctaaggacaccaccctcatccaccaaatatttggaggctgctggagatctcaaatcaagtgtctccactgccacgggatttcagacacttttgacccttacctggacatcgccctggatatccaggcagctcagagtgtcaagcaagctttggaacagttggtgaagcccgaagaactcaatggagagaatgcctatcattgcggtctttgtctccagagggcgccggcctccaacacgttaactttacacacttctgccaaggtcctcatccttgtcttgaagagattctccgatgtcgcaggcaacaaacttgccaagaatgtgcaatatcctgagtgccttgacatgcagccatacatgtctcagcagaacacaggacctcttgtctatgtcctctatgctgtgctggtccacgctgggtggagttgtcacgacggatattacttctcttatgtcaaagctcaagaaggccagtggtataaaatggatgatgccgaggtcactgtctgtagcatcacttctgtcctgagtcaacaggcctatgtcctcttttacatccagaagagtgaatgggaaagacacagtgagagtgtgtcaagaggcagggaaccaagagcccttggcgctgaagacacagacaggccagcaacgcaaggagagctcaagagagaccacccttgcctccaggtacccgagttggacgagcacttggtggaaagagccactgaggaaagcaccttagaccactggaaattcccccaagagcaaaacaaaatgaagcctgagttcaacgtcagaaaagttgaaggtaccctgcctcccaacgtacttgtgattcatcaatcaaaatacaagtgtgggatgaaaaaccaccatcctgaacagcaaagctccctgctaaacctctcttcgatgaactcgacagatcaggagtccatgaacactggcacactcgcttctctgcaagggaggaccaggagatccaaagggaagaacaaacacagcaagagatctctgcttgtgtgccagtgatcagagtggaagtaccgacccacactgaggggtacacacacacacacacaaacacaaatacacccacaagcgcgcacggaaacacacccacacccacacaaacacgaacaccgtgaatcctacataaagtaatgaggagccccagtttctgtctctacaacagggacaattggatagtgatggctgcgtctcaggatgagcccacatatgggaaacatcatgttttggggtcgtgagtcttccgaacctctggagggactgtctgtgtgtttgtgttcatggtagatgacattcagtgtgtatttcttaatgtgacctattgacctgtaggtttgcgtgtgaggttattgcaggggacatggtttactatttcctcttggggtttgtttctttcgtcagttgttggtcgtcaagagaaggtgaaattttgctcatgtggtacatccgtggatcattcttgccaccttgaatagtggatactggaattcaattggaagataggaacggtgctcttctttcttaccctggctcgcccattttattttggtttctgaatggacctcaggtgccctgggacttgtgctcttgctggaacccacataatgcgggaaacagacagaccgacttacctgtttcacggtgtccacttccattgcgtggaaacggaaaattttcccactggcacggaagtcatttggaactaattctcattgatactaaaggaaatcaaacactggagtgtgtgtattcatctaaaatacattcagaaagccctgaaataaacctcatttggtgtgtttacaaatggcatttgaggagattccgggtcattcgtccagctgcgaaagctgcatctctgaaacacagtccctgtcctgcaatcagacttatttatccgacgtggtgtttctgtggaaattattgtgggaaatggccccttccttttctgtatttgctgattagatttcatggtccctttcttgttaggtgcagtgatcaaagttgaccaacccctgaggaaagctgtccaggtcacaactcagggctccgtagaaccacagaatcttgggcacaaccctgctcaagcacccaaatgtgcatacgaacagggtctctgtgtgacgtgtgtgaaaactacagtgtgatgagcatgacttgcagacaggttatcgattgggctcccctcaaaattagttatgagcattaaagcacaccgatgcccaggtcccggctgcaggaataagaccctccaacgtcttgtgtgaagccacggcatctggattgctcatgcttctggggatcattctcctgaaaattgtggctccttcctgcctgtggagcacctctctaagcagtgccctttcttcacccaggacactttacatcaggcacagaaagccttctgatggagcacacctggcccatgaaaagacaagggagaagaaacggggccaaagatcacagtcctctcattccaccatcctccttaaaatcatccgaatttcatgggccctgaggccacggctgtttctttacacctcgagaccttggcgccgggcctcaattctgccccagtgcttactgtctaagacattttgggaaaatccctagagcctggatcttcaatcctggtaagccagagagcctggagacacacccaaattatgtccctcttagttcagggaacatgtccattttcgacagcattaaaattttggcaccaaatgtgctaactgcaattccaccatacaatgcgtaactggaaatggaggcaacatctcatatcctgaacaattcatgcgagaatctaggagacacacggcttacttttgccttttcccactgaaacaagggccagtattaacaatgttatgctatccttggtttcactccccacttttaaatctctcggatgtttacttcttgagacagggcgtcactgccgtcacccacgcttttctacggtgtaatttttgttgtttgcttttgtcaaatttagaaattttcattcatctctatcaaatgttgctccattatcacatacgtatgaaaatattatcacgcgtgctgtgagatacgttgtttttattttcatcaattcttttgtaaaacaaaggttatagttgggataccttctgatttctcaagttttttgtttcatattttcttaaactgccgtcgcacgtccaaaaccactcactatacaatgtcttgaccatctctcttttctggcaaatataaattttcggaatgtcatcagttagtctctcggtgattccattatttccccaaagtcttttacagtctagtttgtgcactgagtatctcttcaaacttcagtgcatgtttctacgacttaatgctttattattcagcaatctagcttccacaagagcatttaatgtaaagacttgtctttttctccactggcaggtaatttcactcggatatagaatcattaggctgattatggaaaggttatcgctgggaggtgtgattgattccacggatctctccttttttattgaggaaaaatatatgctgtgctaattactatacttcattgcctattctcaggtcagaaagcgcacttcagacttctccttctatcgctgaaaggatgatggtatctgccaaaagcacatactcggaagtacatcccagcacaaacacacacacacacacacactcacacagagagagacacacacacggtttcatagataaagatttcttccctgacattcttttacctaaaataaggcaactgtgtggccactgtcccaacccggttacaatcatattatatgtgcctatcatcctgaggagtaatttgatgcaggtgttttagaagtcatgatgtgggctgtgtctgttgaattcccagcgatgcaaggggacacaccctgtgactcattccttaattgagtgctgatatttgattggtttatcgcgcaccttatgtgcgggtggcgtgttcgctcttggtgcggatgagttatgtaagggctgatttggccagagaactcgttatttgaagactctctcggaaaagatagcgtctttctgcaacctgcggtcccagcagaaaaaccttgtgatccttgttccaggcgacatggaggacgactcactctacttgggaggtgagtggcagttcaaccacttttcaaaactcacatcttctcggccagatgcagcttttgctgaaatccagcggacttctctccctgagaagtcaccactctcatcggagacccgtgtcgacctctgtgacgatttggctcctgtgacaagacagcttgctcccagggagaagcttcctccgagtagcaggagacctgctgcggtgggagctggtctccagaatatgggaaatacctgctacttgaatgcttccctgcagtgcctgacatacacactgccccttgccaactacatgctgtcctgggagctctctcaaatgtgtcatcgtcccaagtgctgcatgctctgtattatggaagctcacagcacacgggcacctccaccgtcctggccatgtcatccagccctcacaggcattggctgctggcttccatagaggcaagcaggaagatgcccatgaatttctcatattcactgtggatgccattagaaaggcatgccttcccgggcacaagcagctagatcatcactgcaaggacaccaccctcatccaccaaatatttggagggtactagagatctcaaatcaagtgtctctacttccacggcatttcagacaccttcg

SEQ ID NO: 46 - DNA, 5001 bp, Homo sapiens
gagagttgaacctttccttcgattgtgtagttttcaaacactctttctgtaacatctgcaagtggacatttggagtgatttgaggcctaaggtgaaaaatgaaatatcttcacataataactagacagaagcattctgagaaagttgtttgtgatgtatgcattaatctcacagagttgaacatttcttttgattgagcagctttgaaacactctttttgtagaatctgtaagtggacatttggaacactttgaggcctatggtggaaaaggaaatatcttcatagagaagctagacagaaatattctgagaaatttctttgtgatgtgggcattcatctcacagagttgaactttcttttgattgagcagttttgaaacactctttttgtagaatctgcaagtggatatttggagcgctttgcggcatatggtggaaaaggaagtatcttcacttaaatactagacagaagaattctgacaaacttctttgtgatgtgtgcattcatctcagggaattgaaccttacttttgattgagaagttttgaagcccactttttgtagaatctgcaagttgatatttggagcacttttaggcctacggtggaaaaggaaatatcctcacataagaactagacagaagcatcctgagaaacttctttgtgatgttttcattcaacccacagagttgaatcttacttttggttgagcagtttggaaacactctttttgtagaatctgcaagcggacattttgttcgctttgaggcctatggtggaaaaggaaatatcttcacttaagatcttgacagaagcattctgagaaacttcttcgtgatgggtgcagtcatctcacagagttgaacatttcttttgattgagcacctttgaaacattatttttgtaggatctgcatgtggacctttggagcgccttgaggcctatggtagaaaaggaaatattttcacataaaaactatacagaagcatgctgacaaacttctttgtgttgtttgcattcatctcacagaattgaacgtttctttccattgagcagttttgaaacactgtttttgtacaatctgcaagtggacatttggagcgctttgaggcctatggtggaaaaggaaatatcttcacttaagaactagacagaacattctgagaaacttctttgtgatgtgtgcattcatctcacagagttgaacctttcttttgattgagcagttttgaaacactctttttgtagaatctgcaagtggacatttggagcgctttgcagccaattatggaaaaggaaatatcttcacataacaacaagacagcagcattctcagaaacttctttgtgatgtgtgtattcatctcacggagttgaaactttcttttgattgagcagctttgaaacactcttttgtagaatctgcaagtggacattaggagcactttgaggcctatggcagaaaaggaaatatcttcacataaaaactagacagaagcattgtcacaaacttctttggaatgcgtgctttcaagtcacagagttgaacatttcttttcattaatctattttgaaacactcttttggtagaatctgcaagtggacatttggaattctttggggcctacggtggaaaaggaaatatcttcacagaaaaactacacagaattattctgggaaatttttttgggatgtgtgcatgcatctcacagagttgaactttcttttgattgagcagtttgaaacactctttttgtagaatctgcaaagggacatttgagcactttgtggcatatggtggtaaaggaaatatcttcacataaaaactagacagaagcatgctgacaaacttctttgtgttgtttgcattcatctcacagaattgaacctttctttccattgagcagttttgaaacactgtttttgtacaatctgcaagtggacatttggagcactttgaggcttatggtgtaaaaggaaatatcttcacttaagaactagacagaacattctgagaaacttctttgtggtgtgtgcattcatctcacatagttgaacatttcttttcaatgagcagttttgaaacactctttttgtagaatctacaagtggacacttggtgtgctttgaggtctatggtggaaaaggaaatatctgctcataaaacatggacagaaacattctgagaaacttcttcatgatgtgtatattcatctcaaagatttgaacctttcttttgattgaacagtttggaaacactctttttgcagtatctgcaagtggacatttggagggctctgaggcctctggtggaaaaggaaatatcttcacttaagaagtgcaaagaatcattctgagaaaatactttgtgatgtgtgcattcatctgacagagttgaaccttactgttgattgagcaggtttgaaacatcctttttgtactaggtacaagtggacatttggagtgcgttgatgcctatggtgtaaaagtatatatctttacataaaaactagacagaaggattcttagaaatgtctttgttatatgtgcattcatctcacagagttgaaactttcttttgattgactagtttggaaatctttttgaaggatctgcaagtggacatttggatcactttgaggcctatggtggaaaaggaaatatcttcacataagaagtagacagaaacattctgagaaacttctttgtgatgtgtgcattcttttcacagagttgaacctttcttttgattgagcagctttgaaatgctttttttgtagaatctgcaagtggacatttggagcgctttgaggagtgtaatggaaaacaaaatatcttcatgtaacaactatgcagaagtattgtgagaaacttctttgtgatgagtgcattcatctcacagagttgaaactttcttttgattttctagtttggaaactctctttttgtagaatctgcaagtggacatttggagcgcattgaggccaatggcagagaaggaaatatcttcacataaaaactagacagaagcattctgataaacttctttgtgatatgtgcattcacctcacagtgttgaaccttacttttaattgagccgttttgaaactccctttttgtactatctgcaagtggacatttggagtgctttgaggcctatggtggaaatggagatatcttcacataaaaactagacagaagcaatctgagaaacttctttttgatgtgtgcatacatctcacagagttaaacatttcctgtgatggagcacttttgaaactctctttttgtagaatcagcaactggacattttgagctctttgaggcctatggtggaaaaggaaacatcttcacataaaaactagacggaagaattctcagaaatttctttgtggtgtgtgagttcatctcacagagtagaacctttcttttgattgagcagtttggaaacactctttttgtagaatctgcaagtggacatttggagaactttgtggcctatagtggaaaaggaaatatcttcacataaaaactagacagaagaattctgagaaacttctttgtgatgtatgcattcatctcatagcgttgagcatttcttctgattgagcagctttgaaacactctttttgtagaatctgcatgtggacatttggagcgctttgaggcctatagtggaaaaggaaatatcttcatataaaaactatacagaaacattcttacaaacttcttagtgatgtgtgcattcatctcatagagttgaacctttctgttcattgagcagttttgaaaaactctttttgtggaatgtgcaattgtacatttgaagcgatttgaggcctatggttgaaaaggaaatatgttcacataaaaactagacagaagcattctgaccaattactttgtgatgtgtgcattcatctaacagagttgaacctttcttttggttgagtagtttggaaattctctttttgtaggatctgcaagagcacattaggagtgctttggggcctaaggtggaaaaggtaatatcttcacttaagaagtagacagaagcattctgagtaacttctttgtgatgtgtgcattcatctcacagagttgaacctttcttttgattgagtagcttagaaactctctttttgtagaatctgcaagtggacatttggagcgcatttgggcctatggtggaaaaggaaatatcttcatttaagaagtagacggaagcattctgtgaaactgctttgtgatgtgtgcattcctctcacagagctgaaactttattttaattgagcagttttgaaaaactctttttctagaaattgcaagtggacatttggagtgctttgcagccgacggtggaaaaggaaatatcttcacatacaaactagacaaaagcattctgacaagcttatttgtgatgggtgcattcatctcaaagagttgaaccttactttcgattgagcagttttgaaacactctttttgtagaatctgcaagtggacatttggagagctttgaggcctgtggtggaaaaggaaatatcttcacacaaaactagacagaagcattctgagaaacttatatgtaatatatgcaatcatctcacagaatttcaactttcttttgattgagcaactttgaaacactctttttgtagtatctgcaagtggacatttttggcgctttgaggcaatggtggaaaaggaaatagcttcacataaaaactatacagaaacattctgaaaaacttcagtgagatgtgtggattcatctcacagagttgaacctttcttttgattgaacagttttgaaagactctttttgtagaatgtgaatttggacatttggtgcgctttgcagcctatggtagaaaaggaaatatcttcacataaaaactagacagaagcattctgacaaacttctttgtgatttgtgcattcatctcacagagttgaacctttcttttgattgagcggctttgaaacactctttttgtagaa

SEQ ID NO: 47 - DNA, 5001 bp, Homo sapiens
atctgcatgtggacatttggagctctttgaggcctatggtggaaaacgaaataccttcacataaaaactatacagaaacattctgataaacttctttgttatgtgtgcattcttctcacagatttgaacctttctttccattgagcagttttgaaaaactctttttgtggaatctgcaattgtacatttgaagcgctttgaagcctatggcttaaaaggaaatatgttcacataaaaactagacagaatcattcatagaaaatcctttgtgttgtgagcattcatctcaccgggttgaacatttcttttgattgagcaggtttaaacactctttttgtagaatctgcaagtggacattaggagccctttgagtcctgtggtggaataggaaatatcttcatttaagaactagacagaagcattcagagaaacttctttgtgatgtgtgcgttcatctcacagagttgaaactttcttttcattgagcagttttgaaacaatctttttgtagaatctgcaagtagacatttggagcgctttgcagcctatggtggaaaaggaaacatctatacatgaaaactagatagaagcattctgacaaacttctttgtgatgtgtgctttcatatcacagagttgaacatttcttttgcttgagcagtttggaaacactctttttatagaacccgcatgtggacatttggagtgctttgaggcctacggtggaaaaggaaacatcttcatatgaaaactagacagaagcattctgacagactttttttgatgtgagaattcacctcacagagttgaaccctaccttcgattgagcagttttgaaacactctttttgtaggatttgcaattggacatttggagtgctttgaggactatggtggaaaaggaaatatctgcacataaacactagacagaattattctgagaatattatttgtgatgtgtgcattcatctcacagaggtgaacctttcttttgattgagcagttttgaaacactatttttgtgggatctgtaagtggacatttggagcgttttgacgcctatgctggaaaaggaaatatcttcacataaaaactggacagaagcattctgagaaatttctttgtgatgtgagcattcatctcacagagttgaagctttcttttgattgaacagctttgaaacactctttttgtagaatctgcatgtggaaatttggagcattttgaggcctattgttgaaaaggtaatatcttcacataataactagacccaagcattctgagaatcttctttgtgatatgtgcatttatctcacagcgttgaaattttcttttgatagagtggtttggaaactctttttgtagaatctgcaaggggacatttggagagctttgagtcctgtggtggaaaaggaaatatctacacttaagaacctgacagaagaattctgagaaacttctttgtgaaatgtgcattcatctcacagagttgaacctttcttttgattgagcagttttgaaacactctttctgcaggatctgcaagtggacatttgcagccctttggggcctatggtggaaaaggaaatatcttcatataaagactagacagaagcattctcgcaaatttctttgtgatgtgtgcattcatctcactgaggtgaacctttttttgattgagtagtttggaaactctctttttgtggaatccggaagtggacatttggagtgctttgggaccaatggtggaaaaggaaatatcttcacttaagaactagacagaagcattctcagaaacttctttgtgatgtgtgcattcatctcacagagttgaacctttcttttgattgagcagttttgaaacactcttttcgtagaatctgcaagcggacatttggagcgctttgaggcctatggtggaaaaggaaatatcttcacataaaaactagacagaaacattctgaaaaacctctttgtgatgtgtgcattcatctcacagggttgaaacttactttcgattgagcaatttttaaacactctttttgtagtgtctagaattggacatttggagtccttagagtcctatggaggaaaaggaaatatcttcatataaaaactagagagaagtgttttgagaaactctttgtgatgtgtgcatgcattcatctcacagatttgaacctttcttttgattcagcagctttgaaacactctttttgtagcatctagaattggacatttggagcgcttagagtcctatggtggaaaaggaaatatattcacgtaaaaactagacagaatcattcagagaaaattctttgtgatgtgtgcattcatctcacagagttaaaccgttattttgatggagcagtttggaaaaactttttttgtacgatctggatgtttacatttggagcgttttgaggcctatggtgtaaaaggaaatatcttcaaataaaaaactagacagaagcattctgagaaacttctttgtgatgggtgcattcatctcacagagttgaacatttcttttgattcagcagctttgaaacactctttttgtagaatatgcaagaggacatttggagtgctttgaggccaatggtggaaaaggaaatatcttcacataaaaactagacagaagcattctgagaaacttctttgtgacgtgtgcattcatctcagagtgttgaacctttcttttgattgagcagctttgaaacactctttttttagaatctgcatgtgcagatttggagcgctttgaggccaatggtggaaaaggaaatatcttcacataaaaatgattcagaaatattctgagaaacttcttcctgatgtgtgcattcatgtcacagagttgaacctttatttcattgagcagtttttatttatttatttattattattatactttaagttttagggtacatgagcacaatgtgcaggttagttacatatgtatacatgtgccatgctggtgcactgcacccactaactcgtcatctagcattaggaatatctcccaatgctatccctcccccctccccccaccccacaacagtccccagagtgtgatgttccccttcctgtgtccatgtgttctcattgttcaattcccacctatgagtgagaatatgcggtgtttggttttttgttcttgcgatagtttgctgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcggcatgatttatagtcctttgggtatatacccagtaatgggatggctgggtcaaatggtatttctagttctagatccctgaggaattgccacactgacttccacagtggttgaactagtttacagtcccaccaacagtgtaaaagtgttcctatttctccacatcctctccagcacgtgttgtttcctgactttttaatgattgccattctaactggtgtgagatggtatctcattgtggttttgatttgcatttatctgatggccagtgatggtgagcattttttcatgtgttttttggctgcataaatgtcttcttttgagaaatgtctgttcatgtccttaaaaatcaatgtacaaacatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcttgggtaggaagaatcaatatcgtgaaaatggccatactgcccaaggtaatttacacattcaatgccatccccatcaagctaccaatgactttcttcacacaattggaaaaaactattttaaagttcatatggaaccaaaaaagagcccgcatcgccaagtcaatcctaagccaaaagaacaacgctggaggcatcacactacctgacttcaaactatactagaaggctacagtaaccaaaacagcatggtactggtaccaaaacagatatatagatcaatggaacagaacagagccctcagaaataacgccacatatctacaactatctgatctttgacaaacctgagaaaaacaagaaatggggaaaggattccctatttaataaatggttctgggaaaactggctagccatatgtacaaagctgaaactggatcccttccttacaccttacacaaaaatcaattcaagatggattaaagacttaaacttttgacttaaaagcataaaaaccctagaagaaaaccgagtcattaccattcagaacataggcatgggcaaggacttcatgtctaaaacaccaaaagcaatggcaacaaaagccaacattgacaaataggatctaattaaactaaagggcttctgcacagcaaaagaaactatcatcagagtgaacaggcaaccaacaaaatgggagaaaagtttcacaagctactcatctgacaaagggctaatatccagaatctacaatgaactcaaacaaatttacaagaaaagaacaaacaaccccatcaaaaagtgggtgaaggacatgaacagacattgagcagttttgaaaagctctttttgtaatatctgcaagtggacatttggagcgctttttggcctatggtggaaaaggaaatatcttcatttaagaactagatggaagcattctgtgaaactgctttgtgatgtgtgcattcctctcacagagctgaaactttattttaatttagcagttttgagaactctcattttgtagaatctgcaagtggacatttggagcactttgcggcct

SEQ ID NO: 48 - DNA, 5001 bp, Homo sapiens
tttcctttgagatgccattcctgaaactataaaaacttttctggaaaacctaagcaatgaatttatcgctgtttcgtttgtatcgcctatttaaggaagtaaaatgaacgataatttttgccctcctttacctatggtcatgtgataagcccttaatagaagtcagcttttgccagcggcgcccagtggctcacgcctgtcatcccagcactttaggaggccgaggtgggcggatcacctgagatcgggagttagagaccagcctgaccaacgcggagaaccctgtctctactaaaaatagaaaattagctgggcgtggtggcgcatgcctgtaatcccagctactcgggaggctgaggcaagagaatcgcttcaatccgggtggtggaggttgctgtgagcggagatcgcgccattgcactccagcctgggtgacagaactggactctgtctcaaaaaaaagtcagcttttattatgaggggctctccatctccagatgcctgtaaggaaaggagtgagctaagcatctggaacaccgtgggggttttggactgagtgcctacggtgtattgggccctgtgtaggagtttcatatatattattttataacactatggctagctcttactacccaaattttacaagttaggaaactaaggattagcattacttactcaaacaaacagtgggtgagtggggaaattggaattcatatccagatgtctctgagtacagaaaccatattctctataccacacttttttgtcccttcataacttccatctgtgtgagtggccaggagtaacggattatgcaactgcctgaagcgctctggtcttgtgtccaatgcacaggatgcggaatattcctttaaaatcttcctgcccattccacggctgagtctcatctctagccagcagaaacccatttttagtggctggtaagccactaaatttactctttgtccccaaaatgaccatcattgcatatttaagtacattttatttctagatgcctgattcatttcaagtctatgtaaattgttagtttcttatgaacaattaaatttagagtatacatatgtcaacaacttttctgttagtgaaactgtgagatcctgtcactcagtgtgacatcgctgaaaattaagggattcgcaatcttcgctgacttgtgttccaagtctgggtcaactatttgctgtatgacattggcaatattatttaacctctaatagagttcatctgtttatctattaaaacagtgaaatgatatttatctgaaagaatccagtatattaatttagaggtacacccattaacaaacacattactttatgtaaattggtaatctatatctgcttctgcttattcattactttaaataactacaaagaaaatattcagacccagggacataaaataagcactcaaataacgtctgttgaaaaaaatgaatgtcacttttgtcaaattatttctaaaaaaaaaaaagtaacttatttagaaaatctcaaatctacattaaggaccttgtattttagcattgtcaccacttttactgagaggtcagtagggactattcctgattctggaaggcagaacatagataaggagacccacaaaattggagtctgatctgggtcacattttcaacatttaaaattaccgtgtgactttggtgagtcatttgaattctccattcctgttctctatctataaatagaaataataaagacatttattcttaaattaagtttcaatttttcatctataaaatcaagtgctaaatatacacatttagcaattataatgctatacagagatgtttctgtgatttctattcttcttccaactttgcaccattttgcaaacatcctcatgttaaaggttgcagtttcttccagtttcttactaccatgatgtgctcataaatgcttgaaatcccatttgaataggattcaggacagcgtaaggtgttaatctgaccatttgtttttaagagtctatcctgtttaaagccatgagatacatttctaagtgttctgaactacatcatttaaatcttctcatatcctgtttttaaaaaagtggtaatcttgggtgaagccacttgatcaataattttttaaggtccttaattttctcaactccaggaaattttcctatccattggaccacttgaatttcatctttatgttttgtaggtgtttttggtaatttcctttttactgcattccatgacttttaatgtttccatttagggaattgttctcaaagaatttgagttgaaactcatactacatatttataaaatgtataaattatttacagcttagcattaaaaaaatcaaatatgtccaattcaagtagctggtacagaatcacttattttcttaaatatgatacgttacaattatatcatgttttaaatctctaacaaacctgactccataatatttggctacaagtgtatataatacaaatgcttatatgatggctgagaaaacaaaaattttcattcttacactttttaaattgttattttgtcttcttttaatggatacttggtacagtttcacctggatgctctctatattcaggggaattgcagagttacagggatactgtactatgtggaattgccccatcaattaaatgcaggatcatgacaatgagcaagtaaggaggatttgatgccactcctttacaagaacgccttgctagggtttggctgtgtccccattcaaatctcatcttgaattgtagctcccataattcccacatattgtgggagggactcagcgggagataattgaatcatgggggtggtttccctcatactgttcttgtggtagtgaataagtctcacaagatctgatggttttataaggggaaacccctttcacttggttctctttctctctgcctgggaaaagcatcccttgctcttccaccataattctgaggcctcctcagccatgtggaactgtgggtcaattaaacctctttcctttataaattacccagtctcgggtatgtctttatgagcagtctgaaaacagactaatatactcctccatgggaagaaaaggtttgagggtctttggagaacagggtatgagaggaggatgcccagtaagggggtaccagtgcctgcatctggaggcaaatctcacaggcatttatcacagtcagacattaaattatgttgtattattttaaatgtaagcagttgacaattatgccaaactagaagctactgcttcttttagaagtaggtaataaaataattaactctgaagtaatgtactgttcagaagcagagcagatatacataaacctaaacactaagagctgggtctccaatactaaaagaacgctactttggcactccctgatagagggagcgctattaataatgtggaaacgtttttgctaaaagagaaggattaacattcatgccagcatccaaattgttcttcttaagatattgtatatttatattataaaatatgtcctgtttctgattttattaatttatttcattcattaaagatatatcagcaagtggcagattaggaagctccagggccatattttcccataaaaatgtcaaataaaaaatatatagaccaaagtcactttgtaagaactcctaaaattagctaagaaacaaagcaaatgcctaactgaacaaaaggccacattggaagcagtatgaaatttcatggcatttttcttgcccttaacccacctcctcttcaacatagtgtgatgtgatcaggaggaatttgtccaatccaagttccagcctcaagctggaagaggaagagaggagcttatctggagattgactggaagactatttctatcttacctgatttaaaaagctgatggaagtggtggcatagtttgaatagccattcaaatgaccttgaataggttcaaggtcatttaaaacagacaggcaccatggtgactaagagccacaagcggtcagaagacccccggtggcacagattatagacaaaggaaaacaataaaaattccctgacctctaagaagcagcagcaatatgcctcttggggaaattaagacatttaaagcagccttgtatatggggaactggaacaaaagcatacacacaaggcaaggaaagacacatctccagtaaaagtatgaaaggagcttgtacctttatgccaggatgattagtaaaggtcttcccctgcatagagccagtccacaaaaagctaggagacaaggctacttttttcaaatgctcaattttcaacaaaagatcacaagacacacaaaggaacaggaaaacgtagccccttcaaaggaacaaaataaatctccagtaactgatcttaaagaacagcagagcttgggcttatttgataaagatattcaaacaataaagatgtctaaagtatgctaaatgagctgaaggggaacatgaacagacatacaagcaaactcaggaagatattttatgaatgacatgagaatattaacaaagagataattttaaaatcacagaaaacaaacaaacattctgaacctgagaaacagagtaacttagttgaaaaatttactatagggagacttgatcaggcagaagaaagaatcagtaaacttaaagatatttgtcattgttgaatctgaggagcaaaaagaaaaaagaatgagtaaaagtgaacagagtttaagggacatatgggacattgtcgagtgaaccatacacattatggaattaccataagaagaagagacaaagagacagggagcttatctgaagaaacaatggatgaaaagttcccaagtatgaggaaagaaatgaatacacaggctgggcgcagtggttcatgcctgtaatcccagcactttgggaggccaaggcaggtggatcacctgaggtcaggagttcgagatcagcctggccaacatggtgaaaccccgcctctactaaaaatacaaaaaaaggttagccgt

SEQ ID NO: 49 - DNA, 5001 bp, Homo sapiens
tgtgtggtggtgtgtgcctgtagtcccagctactcgagaggctgaagcacaagaatcatttgaacctagcagtcaggagttgcagtgagtcgagatcacaccattgcactccagcctaggtgacagggtgagactatctcaaaaaaaaaaatgaatatacaaatacgagaagctcagtgaattttaaatcggatggatccacaaagatccacactaagacatattataatcaaattgtcaaaagtcaaagagaatcttgaaagtagcaagagataggtgacttagtatgtacaagaaaatctataatattaacagtgaatttcttatcggaaaatttgcaggccaaaaggcagtgggatgacatatttaactgattttttttaaactcctgccaactgagaatactatattcagtaaatttgtttttcaaaaaaatgaagagaagtaagacatttctacagaaaaactgaggagttcgttactgttgggaaaggcagtcttgtgcatgcaatcttttgaccctcacttggccatgtgacaatgggcctaaggtctggacaacttctttatcacgagaataaagaaccttcatatcctgtactgggattatcacttgtgtgggaatattttagcctgtttcagactcaatgtgtattccttcgttcagcttaaaattgcacatattatggcacctagccaaacctgatactacatttgccccctgcagggaggggaagggttcttctgtagcacaagagaggtatgtaccgccaaattgtcctgtgtcagctgctgggcaggacctactggccatgggagacccatgaccactagtggagctggtcgtgctctgcctctactctgtgtaagtaaagcattaatctattcagcaattggctgtactgtgttttccttggcaactccaataccaagatgcagtaggcagaagtatcagggttttcactcctggtgatagacaactgatttcacttgcttgatagtaaccactacaccattcctattagaaatgttaaagaaagtccttcaacttgcaacaaaggacactaggcagtaacttcaagccctataaaaatttaaagttctttggtaaagataaatgtatggacaaatatttaaaaattgtgttattataattttcatttgtaatgccacttttaattatttaataggatttaaagtttaaaaagcataagtataaatctatattaatgggtacacaatatagaaagatactttgtgacataacataaagtgggagtgtgaagagagttataaaggagtagagtttttgtatgtgattgaagttgctatcagtttaaaattgatttttctaacttaactgttttatgtaatccccatggtaacacaaaagatatatctagagaatgtacacaaagagaaataagaagaaaatcaaataaatgtcactgaaaactcaactgaacataaaggaaggcagtaagtgaggaaataaggggaaaaaacctataagacatagagaaaaattagcaaaatggcaatagtaaatctctaatcataatatatattttggcagaatggataaaaacacaagatgcaactatatactgtctacacaagacttgttataaatccgaggacacgcactggggaagggaaagaatggaaaaaagataattcacgcaaatattaaaagaagagcagcaagtggctatatcgatattggataaaagagatgttaagttgaaagctgtcacaagagagaaagagggacactatataatgacaaaagggtcaattcaccaagaagatataacatttataaatatatatatatatttatatatatatacacagtaagcatcagagctcctaaatttatgaaacaaatgttgacataattgaaaggaggaaaatactgatgtacaagaattatagggactttaatgtcacatttcaataattgattaaacatccagagaaacgatcagtaaagaaacagaggacttgaaaaacattatagaccaattgaaactgacagacatatacaaaacacttcacccaacaacaatagaatacacatttttttctcaagtatacatggagcataattcagggtagaccataggctaagcccccaaaaaagtcttaatacagttaaaagattaaaatcatcacggtacctttttttattatgatggaatgaaactagaaatcaatagcaggaggaaaactagaaagtctacaaatatgtggaaattaaacaacaaacccttaagtaaccaatgggtcaaagaaaaaaatacaaggaaaattagaaaatatactgagagaaataaaaatgtaaacacagtttattgaaacttgtgagatgctgaaaaagtaatagtaagaaggaattttatagctgtagatgtttatactataaaagaactaaatcaacaacctacctttattccttaaggaaatagaaaaagaagaaacttcacacatctggcacacaaaaagatacaataaagattacagcagagataaacgaaattgagactagaaaaacaatagagaaattagtgaaacatagggttgactatgtaaaacatgaacagaattgtcaagcctttagctagaacaactgtgaaaaaggaggaagctcaggggccgaagcgcagtggctcacgcctgtaatcccagcacttagggaggccaaggctggcggatcacgaggtcaggagatcgagaccatcctggctaacacggtgaaacccggtctctactaaaaacacaaaaatttagccgggtgtggtgtggggcgcctgtagtcccagctactcgggaggctgaggtaggagaatggcgtgaacccgggagacggagcttgcagtgagccgagatcgcgccaccgcactccagccttgctgacagagcgagactctgtctcaaaaaaaaaaaaaaaaaaaaaaaaaagcccccagtttacatcacactcagtgttgaaagactgaaagggttttctctaagatcaagaacaaggcaaggatgtccacgtttgccagtctattcaacatagcacttaaagtcctaaccagaacaattaggcaagaagaggaaatttaaaaagatatccaaaatggaaaggggaaaattaaatcatccctcttctcagattatatgatcatacatgtagagaaccctaaaaatatcacaaaaacctattagaagtacagtttacccagaattctactactccttaccaaggagcatctattcttatactgatgtatgacatactttcaaactttctcaatatcaaagagattgtctcaccagcagctaaggctgtattgtactgatctgtaatatttgttatttcaagctggaagatattatctgagagtttgacatatatttgatcttaaagaatctcacagaaaaaggcttctcttatactgtcaaattttgaagtaggaaaaagactttcgagattgctaaaaaaataacctgtaacatacctaaaatgctttgtatcctgataatcccagaattcaggtaaaatgttgatttgatgttcacaaagggagtaatattttagttacttaaatactaacatgggtataatttaaattactctggttaaggatagtacaagactctgtgactgtaaacacttcacctgagccaagtttgaattatttaatgtgttatgtcatttatttattttccacaaagaaatgtccttccccctcaggctgaaaaaaaaaaaagtctagaatatgaaggagaaccatgggaagagaaaggaggcaaagaactacaaagacagatctcacaaaatggaaatgaaatgtattggaattaagaaggaacaccttccttttagtaatatcatagtacagccaacgtaaaacaagaacatattattgtacccaaagtcaatggactgtgtaatgtccaggacaatccatgactcatcacatcccacagccatgttaacagatgccaacaggctcagcggtgcccccagagctacgcctgctagaggacacagcttaaataaagtgaaatacaataatctatgacaaagtggaaaaaaacaaggaagtggaaaaaataagaatgttctttgctgatccacatgttccatgagaaatcttatcaaggatcttataaaagtgataaaatcatagatgagaaagacagttgcagaggtcaaattgcaatttcacattttgtttaatttgttgaaagtatttggtaaacaatctgtgtactcaaataagaataattcaaaatgttgccaccatgttttacaaattattttcaaggataagccatcttttcttctaatgaaattaaacaacagttattaatagtttggcatttctataatggttttatctttgttgattgtaaagtgagtcctcacaacataaaccaaaatgccagcatttcacgagtgcaacatagcagaactttttttttttttccgacatggagtttcactctggtttcccaggctggagtgcaatggcgtgatctcagctcactgcaacctccgcctcccgggttcaagcgattctcctgtctcagcctccctagtagctgggattacaggcatgcaccaccacgcctggctaattttgtatttttagtagagatggggtttctccattttggtcaggctggtctctaactcctggcctcaggtgatccacccttcttggcctcccaaagtgctgggattacaggcataagccaccgcgcccggccaaaacacagcagaacttctattgctttacggggaagggacttccataattaacatggactgaaaaaatgaatttaaaataagtgtgaaagggggcatctgacatgtgcaatgatcattaatctcattgcgggacctttaaaatccacctacatgtgtgagggaagtgtttgtctctatatttttgttcctctaagtaggtctgaatcccattagggtgaggcacctggggaagc

SEQ ID NO: 50 - DNA, 5001 bp, Homo sapiens
cacctaggaatagtgattcctgacatgtttctcacaatttaatacttcataatttagaaagttttcccatacattctctaatttgagtttcacagagatcctgtggaagaactctgggcagatagaagtccagaagagaaacaacagctcaggaatgtcacatcattggtccaggagctgtttccttatttcctctgaacctaattttactgagaatattttttttccttagaaaaaattctaaagacctcaatttttttttttttttttttttagatggagtttcactcttgttgcccaggctggagtgcaatggtgcaatctcagctcactgcaaccttacctcccgggttcaagcaattctcctgcctcagtctcccgagtagctaggattacaggcatgtgccaccacacccagctaattgtgtatttttagtagagatggggtttctgcatgttggtcaggctggtcttgaactcttggcctcaggtgatccatctgcctcagcctcccaaagtgctgggattacaggcgtaagccactgtgcccagtctgcaacatatttttaatttctgaaaattatactttgaaaataaatattctagtaataaaaataggtaactcaagggacacagagattcgcttttggtcagagaaaccatacttccctttactggaagactgatttttttttttttaactactgaactatgacaggaatgttttgaactggagcactaactatgggctacttgtgtatctaggcccttcctcaataaatttacaatctataaaagaagaagaaaaccagataatacaacttgtaagtagtactgtgagagatttttagagaaaaacgtgctggcatataaaagggtcatgaggctctattgactcaaacttgttcaagaagtaaacaaaagcctaaaagcctaatgataacaaaaatgtgcatttataagtatgcagttttaaaaagaacgctacattgattttctgccaccactctctaagactcccttctgtaggttgctatgctgggctttatgacagctctaacacctgctcctccccagttctcctttgcctaatttctgatgtaggtgttcataaaaatcctaccccaatcttctttgcttctcatttccatcctctacttggcaattctatccattttaccaggtttaagtaactatcactgctatgtgttcatgctcaatttatcttcttagctccagaatagaagctactgtggattatttatatgtgggtatctttgtgtgtgtgtgtgtgtgtgtgtgtgtgtgatggagtctcactctgtcacccaggctggagtgcaatgacgtgatcttggctcagtgcaacctccacctcacgattttaagcgattctcctgcctcagcctcttgagtagctgggattacaggtgcctgccaccgtgcctggctaattttcatatttttagtagagatgggggggtctcaccatgttggccaagctggtctcgaactcctgacctcaaatgatccatccaccttggcctcccaaagtgcttggattacaagcatcagccacctcactcggcctatatgtgggtatcttacagattacctcaagctcaacaagcacaaaactcttctaggcagcaaatctctaaaacctgctcctctcctactcataattgccccattatcactcaggcttgaagccctggaattgtctttatttttcaaacatcctcttctttgattctctttctatgtgcatttagatctcctctttcaagttgccaaaggtacctttatattatatcatgtaaatatttttgatattttactcttctaaatgattaagttgtttggtaaagaacaaacatccatactcttcaatcttctatccttagctttcatgattggagccaattctatgatttcttattcatccaatctgtacttccaacgcttccccggcacatcctgctgaaatctctatgtcggcctatcatataggataacagtcctgtgttcttattataaaatacagaatgtgggggatttaaagaagaccatcttttacctcctgtgaaagttaaagggagcatagtctacaaggccactctcacttctaacaccagttgcaagttcaagggattcccaaaactactttcaggtttggtaattcactagaagggctcacagaactcactgaaaggtgttagactcatggttatgatttattacagtgaaagaatacagattaatatcagtcaagaaaagggaagcatagagaaaagcccaagacagtaccaaatgtgaagcttcctattgttctctccctgtggaatcaggacagcatttcctggcatcaatgtgtgacattgcttaggtagtactgccaagcagggatgctcacctgagccttgatgtccagagtcttatccattactagatagttgactgtgcatgtggctgtcttaagttttcagacctataggacatgtagcctgtgactcaaagctccaaccccactttaaatcacattgttaatatcttgctggctcaaggtccccaggaaagcaaagatgttcctatcaggcatgatgttccaagagctagagattacctccaagaagccaagggtaaaacccagacctttctttaggcaagactagcctgggcaacataggccccatttctacaaaaaaataaaacgttatctcatggtggcacatgactattgtcccagctattcaggaggttgaggcgagagggtcccttgagtccaggagattgaggctgcagagagctctgatcatgctgctacactccagcctgggtgacagagtgagaacttgtcaaaaaaaaaaaaaaaatctttactatggaccctcctactttcttaggttttcaagatgtgtatgtagataaaatggatttgtaactgggctgaaaaacctgtctttgaatctggaaacacctggatgtctggtttttttactcttggctaagctagggtcagtaagatttatgtaattctgtttatgttctgacccggagactttaatacttactttctttactaatggtttgccactgacataaccaggtgaaaagcgtggcttgcttatatgactacaggaacttataacacccctataagggcttctctgaactcccacaaagccaaaattcctggtccagatcttagaggttcaaattagagacacagcctggtcccgtgtatgaaaagaaggtggccctggagagttgggatgtcaaaatgtctcttgtactcccaatgtttgcttgctttttccttctcttgctgtatcacataatttgcatttttgtaaaaaaaaaaagtacactttgtgtaatctgatgaatcctttcaaatatatgaactgtgggaaaaaaatataccagagtttattacacttgcagaaattttactaaggattagaaaaatttcaaatatcataacctgaaccaagaatttcatatgtaattaacaccactatctccttcatagttcagaaaagtgataagatgaaattcaataaataagtctggggtttcagtaaatataatgtcaaccactttcttactattgaataacagtttaaattttagttacttttatgattttaaggtacttcattaatttaactactaaaaatatttgttagattgcacactaagtttcagactctcaaaaatgatgaaaattaataaaaactatattataaagaagtagttgaccacagcagagacagaggtatagaaagaaaactgagcaagtctggtcagaggtaggcctggcacaaggacctggagaaggcagtgtcaccgagagccggtggaggaaatgaggctccataaacagaactttggttgtgatctctggttttctagccaaactgtcttgtaatttttctctcagattctcaaagaaatgggcagcaattgtaaagtgacagtaatgattcagctaattaccagacaaaaacaaatgatgacttaaaagcaccatctctcaacaagtataatttaggccttctatggtcatggattaaaatacttaatattgttgacatgtcaatactcctcaaagtaatctatagatttaagcaatcccgataaaaatcctaatgtctttttttttacagaaatagaaaagtccattctaaaattcatgtgaaatttcaaggacccaaaatagctaagacaatcttgaagaaaaagttaaaggactcacactttcctgactttataatatgttataaaactacagtaatcaaaaccaatatatttctggcataaagacaggtatatagaccaatgtgataaaacagagggcctggaaagaaacaatcaaatatttggtgatgtcagataaggataacaaaatcactcgatggggaaagggcagtctctttaaaaacggtgttggaaaaactgaatatctgcatgcaaatgagtaaaggtaggggcttatcttacaccatatacaaaagttaactcagatggattaaaagcctaactgtaggatgcaaatctatacaactcccagaaggaaacatggaagaaaacttcacaatattagattcggcaatgatttcttggatatgcctccaaaatcacaagcaacaaaagcgaaaatagacaaatgagattacatcaaacttaaaaggttttctgtaccaatggcacaatcaacagaatacaaaagtaacttatgacatgggagagaagatttgcattatatatatatatatatatatatatatatatatatatatatatatatatgggttaatattcagacaatctaaagaactacaattaaacaagaaaaaaaatcaaataacctcattaaaaaatggagaaaggggcttcaggagacatttctcctaagatgatatacaaatggccaacaagcatataaaaagatgctcaatatcactaatcattagaggaatgcaaataaaaccaatg

SEQ ID NO: 51 - DNA, 5001 bp, Homo sapiens
gtaaataaaatgataactgctatggaaaacagtatgccagttcctcaaaaaattcaagacagaactaccatatgatctaacaatcccacttcttatggttaattttatatgtcagctacactgtgctatggagtactcagatatctggttaaatatttctagatgtgtccatgaggatgtttctggatgaaattaacatttgaattgataaactgagtaaatcagattgccatttgcaacgtgtgtgggcctcatgcattctatgaaggccagaatagaataagaagctgaccaaaaaagaatttcttctttcttcctgtctttgagctgacacgttggtcttctcctgtctttagattgaaatttatgccactgggtctcctgggtctgaagccttgaaacttagaccataaccataccatcatctctcctgggtctccagattgtcgactttagatcttcagcttctcagcctccatagcacataagccaattccttatattaactggataacctagattagtacagtatataaccaaaggtactgaacacaggatctcaaagagatatttgcacactgatttcatagcagtactattttcaataaccaagagtcggaggcaacccaaatatccatcaatgaaagaatgagataagcaaaatgaggtctattcataataaaatattattccactctaaaaaaatgaagtactgatatatgctataacatggatgaactttaaaaacattaggctaagtgaaagaagcgagacacaaaaggtcacatattgtttgatctgatttatacgaaacacccagaaaaggtaagtctatggaaatggagaacagactagtggttgccaggagctgggcaagggagaaatagggagtaactgcttaaaggacatgtggtttcctttagggttgatgaaaataacttggcactagctggaagtgatagctgcacagcaatgttaacgtgctaaatgccactgaattatacacttaaaatggtgaatggttaattttatgttacacgaattttacatcattataaaaatttgacccaaaaagtatgatttgaatactcttgatttacaataatttattattaaatccttacatatgggtcttccaggttaaggttgagttccagataataaatttagtaaaatggccctacaactgtaaatatgctgcatttcaaattgcatgcatatgcaattttgcaaaatagataggcttttaaatgtttgataagcacattccaaaaaggcaaagtcagtaaaaaagtaaagctctcaaaattaggatttgactactttgttttcaaaaatattgcattaatatttaacctaaaattgtaatttctaaatatcattcgataaaaaaccagattactaaaatctgaaatataatccaaagaagaaagtgctaataaaattaaactattttttctgtgttttttgagacaaaattaaactattttttcttcccaattatctcctatagaaaactcttttctccaagattatttacacaaaagactgagaaaacaagattatacacacacacacacacacacacacgggtgcatgcacacagtttacagtaaactacactgactctccactttgtcaaaacaatagtctgttcttggaattattctgtctctaatcttaatcattcattgaactttctcagttacatgtcctataaggttataaccatcatattctactctaagggtgccaagttagtaaacaggggtggcaatgagattcacagtatggtccaaagagatttgatacggtctaattggacataggtatttgttttgccctctttttctctcttgccagaaaatgttcaaattaactctcatggcctgccaaaacactactttattaatgacttggtagagcaatatactttcctcattgaaagtttgtagagcggtatactccttgctgtcagtgaaacattcaaatagaaagtccaatgaattaaataatagatgtgatagttttattaacatttaactttgtcaaaaggatcattgagaagacaatcttttttcttgcaaacagaaaagcggtagaaagactaaacacgactttttattatttctccttatatttctccagcattggaatcctgatctacttagtaatgctttctcaaaacactagctaccgtttatgttggtagaaccagaaaaatgccctaatgtgtccatagaaaagaattaattttggccaggcgccgtggctcacgcctgtaatcccagtgctttgggaggctgaggctggcggatcacgacgaggtcaggagatggagaccatcctggctaacacggtgaaaccctgtctctactaaaaatacaaaaaattagccgggtgtggtggcagcgcctgtagtcccagctactccggaggctgaggcaggagaatggcgtgaaccctggaggcggagcttgcagtgagccgagatcgcgccactacactccagcctgggggacagagagacactccgtctcaaaaaacaaacaaacaacaacaacaacaataaaaaaagaattgagcactttatgaaatactttttatattatactatttcttcctttgagaaataccattattagtgcacaaccgatcaccatagcttaaaatcagattacaaaatacaaggaaaatacttacaataggaaagttcacccctaagcatttctttatgacacttttagccatatgaactcaccactatttattagaatgcaatatctcaaaatagaatatggtataaaactgattttttcaaataaatacataataaaaattattaaaatatataatttataaaatctaaatgtttactgatacatgttgtatttaatgttaatatatccaaaaagtttaggctcaaacttcataatagtgacccttttttctcagcttcccccccaaaaaaaattattaacctttgtgtatttctctactttgttcacagatacaaaggccagccagatggagctggtcaatgttcccagatcttaagtgcagtgactcaaatctaataaaaaggcatttggaatacagcattgataaagttgtatgactgtacagggaaacattctgcttgtagccatgagatatgaacttctgtttactacttcttctaatagttactagaaatatgagagccaatagaccctttatttttatttcaccctttcctctgagttgtattaaatgacatttcgaatgtcaaatgaatctgatatctacagtcaaacataacagcatcaatggtaaatgtggccaaggagtcagatatgtcaattctgcgtgaattaatctgtttgtgcaaatgatatttatcattacctatgatcagcacttttagctttatcatatcataatttacccaatatgtataggtgtcaacatgtgtgaagataggcaccagataagcaagactcattaagatgttgccatagattaatcctacagagtagaagcatttggctgctctgatttttaagatccctgctttagagcctagaaaatatcatgaaaatgaattaatcatttttcttttcagtatcgtcaacaacctttagtattggagatgttataggaaatgactacctgcttgtaattccatttttagtcaaaactaatacagaagtatttgctagatttggaaatacccaaatgtaagtcagtggcctaatctctaacgggtttaatagcctattttagatgagatcttttccagtaagtgttgtcttccagattttcatgtcctctcgctaatgttttccaaggtggaatttgggcatatgagggctcatgtaaattcatggcattgggtgggtggagagagtttcttgggacatatgagtatctgtgttggtctccactggtcaggtccttcagtccttagatccttagatgacatcactaaggtatagttaatctatacttaatcacaggtgttttttttaacaccacttccaaagtctgtggttgctacgtcccactggccattcagttggcataagccatattcccagaaacaagtacatcgccctttgctgatgggtgccacatcatttctgctgatgctataggcactccaaactctgattgtaaggcctacttgattgctggcattgagtagcattgctgcccttgactacagactcaattaacttcctgatcatttcctctgttaaattgtacccagattctcagctaatatatgtgttgtcttgaaagacatgtgaaaaactctgtgccagagggaaaagaagagctctggatggtctcactctggtaatcatatgcttccacttccactcacaagtcattgggcagaattagttacatagttccaccctacctcaagtggacaggaattacaattatgctgtgtacctgaaagggaaaagaactggaaacatttgttgaacaggctaccacaagtaccctgccaagtgatctcccttcaaaaactcaagtaggaagctaaattaaagtcatcatctcttcttcacttgttcctcagtgtaactaagaagacttgacttctgggactttagctctgatagaggagtttagatatgtgtctcacctcctgaactttctgccttcatccccttttcattctcataatctgtcatgaccagaaaaaggggacgccttttctgggctgatgtggaactacatggcctcttattctcctctttttggattggtattgcaataaggtaaaatgatggctagggaacatgatttactaagaagaagaatattaaacatatttactattttcaaatatgatcctgttacatctgagtttatactccatacagcattttatgtacaatatttcctacaatattgtcacaaacattacaaacctaacaataagcttttattcactttgtttaacttattatttgctgatgatgctttactcactccctctgggaa

SEQ ID NO: 52 - DNA, 5001 bp, Homo sapiens
tctggggtacatgtccacaagtacccaatgcttagctcccacttataagttacataggtatacatgtgccatgttggtttgctgcacccatcaactcgtcatttacatcaggtattcctcctaatgctctccctcctctagcaccccaccccacaacaagccccggtgtgtgatgttccccgccctgtgtccaagtgttctcattgttcgattcccacctatgagtgagaacatgcgaccaccctcaagattactcaccttccaaaagccccacgtcctaatagcatcttgttaggggttaagatctcaacaaatgcatctggaagggacacagacattcactctgtccattgcactgtatgatttaatttatataaagttctagaaaatgcagctgatctgctagaagatcaaaggtctgaagaaacttttacaggtctgtctttatcttaattgtaatgatcatttcacaggtgtacatatgtatgtcaaactgtcccattgtacactttaagtatgtgtggtgtattatatgccaattatatctcaataaagctgattttaaatgtcacttaaaaaagggatttagggcagttcttcaaatctttggaatgtactattacatcccagtttaatgtatgtaccaagatatgtgatgacatgtgcctctgtaatctatgtgcctcatttcaagccacagaactgcttcatttaggagacttgatgacatcacttataccatcaacctaacccctagccctgattgctgtcattaacatcattgtcattactacagtgggtacgtgcatcatgccttcaccttcttctctctcagaaagaatccttggttgtccctagttgtctgaaccaagagttgaaaagtctaggatggttgaatctgaccactggggtctaggtcaatatgccacttgatagtttcaagggaggctgggaaaatgagtgtctggccttttcccttctgatgtaggagtcagactgtcttgcaccaagactcatatgttgttatctgtaccatatgctgtatttatgccctatagatgaatgtctttcctaccctatggatagcagaaaatatgtcttaatcatagtgcaacctccactctgccaggaatcaactaggtactcagtcactccttgtggagtggaatggaatgggatggaatggaatggaatggaatgggatggaatggaatggaatggaatggaacggaacggaacggaatggagagataactatctcacccatatcactccctttagaagtgctgagggccttctaaatctcttttcaggctggaagacctggctacttcctgaatccatgtatgagttgggtaaaaataaagccttatttatatgggatagaatatgaaaggagattgaagaatattcaaaacttcctgcttacaaacttctgaagtttgcaaagttgccagagcctaagaaactcaacatacaatgcttttagctcttcttggacagatagaccgagatgataagctggattcatcaggactgagtacatatggaaaacagggattgtggagagagctgggccatgtgtcaaatgctactctgcccttattgcctacatgaccttgagcctgccctcaccctccgctcatgtgctgccagcatcttggtacctggctcagtatgaagcatgtggcctgggcctaacctctcaccacatcacattaccctgaacatgtgtaataaagctgctgactccatgattggcatttggccactgacaacctccccaggttcactctctgcgtgtgccccttccccaatcacctgtgtgacccaataagagaaatgcctggacactctgtggatttcaaatagcacagcctctagacagtgctgaggaaactccaccctagtgacaccctcaaatcgcccatgtggcttcgctcttgcttcattccatactggacctgagcctttctcctcggggaatccttttactgttaactgtgtaatacatttacttcatattcatcagtgcccatgtgtcatttatcctgatacttacataaataactggttggggggatgttttatatccccaaattctagcacagaggttggctcaaggctggtctcaaatgacagatggatggatgtatggatggatgagtggatgggtgaatggatgggtgggtggatggatgagtggatggatggatggatggatggagggatggacggatggttggatggatggatggatggatggatggatggatggatggatgaattgattcaatgaatgattcttcatcctgattagtaccttcacatttggaaaatgtcactcatcatcacagaaaaatgacagcccaggcctgaacacttcagttgagacatctgctgagatgagagacacgacatgttaaaccacctcctttcaggagctaaccatgctttaagattccaatttaaatctactcttttccttttcctaagtcaccacgagaatgttaattccccccaatttagttctaactccttctagttgagaagagaatgtgatgctaaattgaagagttcaaccccttagctgagaataatccttacaaaatgtatttttacctcattacttgttgaccaaaaccacagccttgtatatatgatctgaaagagcccataaaaaaggctgtgtctaaaaaccactatttgcttttggctgcacacagcaaaatttgatttgcgatgataggaatgtcagtctgacaatgcaactgcaatttctccagctatttacctttaaatctcagtattacacttgctacagatgatatatgaaagtaaaatatttgcacagttatgtgattcagtcaagagtagatacagtactgcacctgagggagaagaaggtgctttggctgaccttaccaggaccgacatttttgtagtaaagaagcaaactttagtattgttctgtggatgtgccctgggtaaggtcactgccccactgatagctattgacaaactctgctgagatatgatataatcaaaatctcagcttctgtgtgttagggggtgggaggtgtgcatgtttcatgttgttatagatgccaacttaagcaagtcgttttcctaaaccttgcaattcttaggttctttcttataaatcccaaatctgctttcctttgcaaacatggctaatgccccttggagaactctagcctgcctctccttgcctcactccctagggtgagggcacggggattgcaatgaggcatgtgaaacaccacgtgtgtctaagaaaggccctacctctcagattgtgattatttaaaacagcttgttaaaaaaaacacacacacacattaatttacccctaagtaaagctcattttgttgctaatttaattttagtgaaaggccttatgtagcatgcgccccaggaatttctataagatctatttatccaacccaggaggattatctgactcttacaagctaatccacttgaaaagtatgtctcagtgccataaggaagcatgtgatattctttacattatgagtgtttgagttggatctggaataaataaggtaggttgcactctcagccacctatgcctctgtcattggagacacgtgagctgttccagggaggtctgtagtaactgctatttctttttattgtcaaaaaatccaacaataaacttaatgtgattgccaagttggcacatagaaattgtttgcaccaaattcaatcaataaatatttatggagttgctaccatgtatcaggcactgttgtagattctgaggtgaggatactgaggtaagatgctgaggttgagcccagctcagatgctgaggttgtcctcaggagctcatatgcaaaacatgtggggaagacagacatggggcaattgaacaaagcgacatggaataggatcagctagtgattaatgttgtgaagaaatatcaagcagtgtagaggaatagagagtttggaaggaggttatattttaagttttgtgaccaaggatgggctctctgtggaagtgacttttgaccaaagactagaatgaagcgacagaaagtcatgcaagaggaggagagctttccaggcaagtgcaaaggccctgaagcagcaacaaccaggaggccagcgtggcagggagggagtggtggggaagaagactggagaggtagcctgggaccagctcacacagggcttcttcagtactggtaagaacttagggattgattctaactgaagggccagtcaatggcttaggatagggaaaaattggctccagtttatattttaggcggtgcttttttctttggtcttgtcatctttcttccatactgattcatatgactgttccttgagtcagatgaactctcactgtttctatgtctgcaagcttcagtcaatggttattcatgtacctgggctgtaagacaaaagcaaacaaattctattctcttcaaactcattaaaaccctggtaccaaagacacagtttgctcaatcctcaggcatgtgtggaggtttggttgttttattttttccttctttttcttttctggttcttcggaaataatctctttgggggaagaattttttgaagagatgtgcctagaaaaaaatttattattaaatacatcttatttgaaccgtgatatgggcaagcctctttttaaaatacattttatgttttaattaatatgctttatttttagagaagttttaggattccagcaaaattgagcagatagtacagaaagggcccttatactctctgcctccacatatatctccccaactattgctgtctcacaccacactggtaccctctgttacaagtgatgaacctacattgatatatcattatcacccaaagtccatagtttacattagggagcactcttagtattgcacattctataggttttgaccaattgtaaaataatgtgtacccaccattatggtatcatacagaatggtgt

SEQ ID NO: 53 - DNA, 5001 bp, Homo sapiens
tatataaatttatatatatttatatttttatatttatatatatttatatatattatataaatatatataaatttatatattttatataatatatataaattatatatattatatattatataaattatatattatactatgtatatattatatataagtatatataataatatatattctatatttatagaataatatatattattatatatttatatatatataataatatatattattctataaatataataataatataatatattatattattatataaatatgttatatacgtgtatataatatatagttatatataatatatagttatatattatatacgtgtatatattatatacacgtatagaatatatagttatatacacgtatagaatatatagttatatattatatacacgtatagaatatatagttatatacacgtatagaatatatagttatatacacgtatagaatatatagttatatacacgtatagaatatatagttatatattatatacacgtatagaatatatagttatatattatatacacgtatagaatatatagttatatattatatacacgtatagaatatatagttatatattatatacacgtatagaatagttatatataacatatagttatatattatatacatgtatataacatatagttatatataatatagttatatacatgtatataatatatagttatatataatagttatatatattatatacatgtataaagtatatagttatatataatatatacatgtatataatatatagttatatataatatatagttatatatattatatacatgtatataatatagttatatatataatatatagttatatatattatatacatgtatataatatagttatatatataatatatagttatatattatatacatgtatataatatagttatatatataatatatagttatatattatatacatgtatataatatagttatatatataatatatagttatatattatatacatgtatataatatagttatatatataatatatagttatatattatatacatgtatataatatagttatatatataatatatagttatatattatatacatgtatatagtatatatatttctttactgctgaatattcgacatttagtatagtacctagagcaaagcaggtattcaacattagtgataaatgttgaataaattggctgaattccccatttaactccattttaaaatggagttaaaatagagacttcaacccttgagacagtcaataggcattgattaaaaattctgaagagtaaattaagtgctgtgtatttactctctgattagtctgtctggtccatgccttgaaaaagctctcagtgtacagttgttatataattaaacacgataacagtaatggggttatactgacacagtctacaccaaataactgaagcgaatggataacaagtgggagatgatatccttagttctaggggaatgtagagtgttccttggagggaggaaacctgacccctagatgcctaccaagtagccaaatatcaccccttcaccaccaggctctctttgccactctggttgtaaggaaaaaagtcagtctgagaacaacccttgtattggggctggagacttctgcatatatcaactcataaaaagataggttgaaactaatgtgacctagctgcatccccttataaccttttcacctacttttaaaaaattgactctaaaatttatttgaaaattcagtatggtagaaagagtcaagatatatctgagaaagatgacaagttacagtatttgccctaccataaacatatctaattagtgcatggatagcatcatataaacaaatagacaaatggagcatttaacccagaaaggctgccatgcatatgtaggtgctagatttataaaagagttggcatttcagataagtgagaaaaagatgtcttttttattagaatgctctggatcaactttgttttatgtggaaaaaacattccaagtaaattaaagatcttgatgtagcagacataacttcacagctttaaaaataattgtattaattaagaaacaattggtagtatcagtaaaactgcaaaatatagatactttgaaaacatagacttttatttgtctttcaataatagttcctagatgggtcatccagattgccaggctgctctattcccctcagtaattcaaggacctggtccttttcattggtccttcttcatgtcttggcacatatccagagcaccctcatgttccaactcatgggatgtggaaagatagcaaatttatcatttaaagtgaccttcatttctttgtgtagatccatttgtatctggtatcatttttcttcttcctacaggacttcttaaatatttcttatactgtaggcccactgataataaattcccgctgcttttttatgtttaaaagtcttaattttgtcttcatatgtgaaagatactttcactgcatattgaattctaggtttaaagagttttttacccccagtagtttaaagatgctgctccactggctcccatcttgcatcattttggataacaaatctgctatcatctttatcttaattcttctatatataacatatcttttacttctggttgcttttaagtttttcttttatcatcagttttaggtaatttagttatgatttaccttgatgtttttttcttgtgttttgggtttgttgagctcttggatctgtgggtttatagtttttatcaaatttggtaattttctatttctttgaatatttttttctgtctacctctccctctcagagattccaattacacatatgttaggagcttgaattacttccaaagtccactgatgatctattcatttaaaataattttctccatttatttgggataatttctattgctatgtcttcaaatttataatattttcttttgcaatgtctaatttgttattaatcacattcaacatatttttcatctcagacattgtaattttcctctatagaagttcaatttggaatttttaaaaatcttccaggtatcaatttagcttttgaaaatatggaatacagttaaaaatcaccgttttaatgcccttgtctgctaattctaagatctgtttcagctctgtacctatccatttggattaatttttctcttcattatgagtcccatgtctcagattttctttatgtctagtaattttggattggatgccagatatcataaatttgacttcttaagtgctggatatttttataatctcataaatattattgagctttgttctgggatgcagtttaatgacttggaaaaaatttgttcctttcaagtcttgcttttaagatttgttaggcaagactggaacagtgtttcatgaagggctaattaccctcccttactaaggcaagaaccttgagtactctctgcagtgtccttgatttatgaggttttccattctgcctgatggaaacaggcattgttttccaagtcctgtataagtgctaggtgcttttccatatgatcttttgggtatctccctcacaccagggctcaagtagtttcttcacatatgtgcactaatcactaccctgcagaatacataatgaggatccttggaagatgtcagagggtctttttgcaactcttacttctctgatactctgtctatgacctttagcctccttggtctcccaagactctcagctccatctcttcaactcaagaagtttgttgggtatctcctggtttgcccctccctgagccacagcctggatgcctctcaaggcatttagctaggacaatcatagggctcatttaatttgtttcttatctctcaggaatcactatcttccattgtctaatgtccactgtcatgaaaactgttcttttgtatgttttgtcctgattttaaaaagtttttttaaagatgagactgcaaatctagtcactgtactccatattggctggaagcagaagtgagacctactttttaaaaaaagtaaactatttgaaaaacttaagcctgtttctgatgagggattctctatttggactgaaagcaaaacatgctgagtagcagtattcctcttaaacaaactaagtgtaaagcacctttctctaaaatcagcaaagcacactgcaatattagtatgtttcttttttttttttttttttttttttttttgagacggagtctcgtcctgttgcccaggctggagtgcagtggcgcgatctcagctcactgcaagctccgtctcccgggttcacgccattctcctgcctcagccttccgagtagctgggactacaggcgcccgccaccacgcctagctaatttattgtatttttagtacagacagggttttaccgtgttagccaggatggtctcgatctcctgaccttgtgatctgccctcctcgacctcccaaagtgctgggattacaggcgtgagccaccgcgcccagcccaacattagtatatttctttgggtttgtttactttcagaaggccaatttatattgttatcttgtgcaatgcatgtttgctagaagtacacccaaactttagatgctaagactgtccgtttgagattctaattactacagcgatcttttcaagcaggaggagagcagaagtgagtattacactgacacattttacactctttttttcttttctttctgttaaaaaaaaaaaacaaactccatactccataccaactatttgaaaggcttatctagttctatttctgcctcctttcaaaagacctgaggctttcttttcagcctaatttttagaattataatttattataacccgaaaaatgctgaagacaaaaactctgatatccttgagggggcagagggtcatagagaggaacagtcattaaaaaaaaaagtcttgtctcttagaaaactatctaaaagaggcacaag

SEQ ID NO: 54 - DNA, 5001 bp, Homo sapiens
aagtgggaattggaggctgataaagggaaaccgccatcattagaaatcccataaattctcatttacaactccctgccagatgaaaggagcaattgactgcgttggagggaaaagcaaataccgatttcctttaggactgcccagcctcagacagctggtcctggaaggtcctgagggtggggggatcctgttccatcagggctgtcctcaactctgtgcactttctctcccctctgtctaggtccacgtgtgggtccttaagccccttgaggaaaagggaggagaaaaggacaaagaaggctctccctttcccttggatccccttctactcccacatgcctagtgggagcctccctcttctgcttgagccttcaggacaggttcaggaccctgtctcctacctggctgggccagaaatgaggaacatgttgcaagccttcctccacctgacttgccaagtccatacaggctggggccttagatccaacaacttagaaaggtaatgagggcagcttccttcaaagggccatgttcagtggggaggttgcctgatgatgaatggagaagtggagtgatggccccttaatctacttctgatgctgctgcttcactctggtttcatcattattttgtggcttagtttctctatctgcaaaatgggaatagtaacaccaaacttatagtgctactgtgaggtgtgtaaagtccacggcacaatgcctggtacaatgctgggccccacagggtcaggccctgttgcctgcctgggcagcttctggaggaatgcctcggctgccagggctggaggggtggtgtggcaagagatgcctccccagcctcctgggtgtgccagctctggctgggagggaggggcagggaggggacatctgtttgacactcttatcagcatccattacctggtgtgtattttcccaggagctgattacattacagcatgtgttgataaacatttggagtcggagtacagaggaaactgagcagaatgttaagcgggtggtgctttggtcaggagatgcagagaaagggctggctgtgatgagctgggagtggtgatgagggccccaatctggaggcttcttcacctgcccagcccctttctctttctgatctccctccaccctactgctctggccctagcagggcatccagacgtggtcctagaggcaggctgttatagcagaagaggtatgggacttgggcctgaggcggttatggggtccagtcccagctctgtcataaactggctcttggcactctgggccagtctcttacttccctgggcctcaatgtcctgctctgtaaagtaggcttaacatccgctccacagggtggaccgaagattaaaggagtaaccatgcaccatgccccgcacatagaattaagcgctttgtctccaggctcttttcctgtggtccccagtttacccccgaaaaatggtcagtcttgccttgactgtgcctcagatgttagactactgcttttatttcaattttgaactaagaggaagtgatttatgttcttcataaggcaaacacccctacttccaaccctagttagggctggagcaggtaacccagggcgagggttgactcttctcccctttttctacacctgtgcacgtgcaagacagctgtagctagggaattatttgtgtagttatctgcctgatgtctttcccccactagtccataaactccctgaggacaggtcacaattgagtgtctgaagtccagcccagggcctggcactggcgggaatgaatgactctcccccatctgattggtctggcgcagaatggtcaagataacccatctcggggttctgtgctgtcgaattccacggttgtttctgaacttagcgcaccgggtatacctctcgcttggcctttgccatagatgaccttggattcacttttcctgtggggtatctctctagtctctctgaggtttgggcatttagaccttcaagagaaggatgtgcacctgtccctctgtccgactgtccaatttagtgggcatggacaaatgcacgaatgaatgagactgcgggaatgctgcccccacctcctctccgcctccccacctcgcctccaggtaccctgggcgcctgggaccctgcggggcctcctggaggcgggacgggcacggcgccacctagcggtcgtgggccgcggagagagcgtccctgtccttccccgtgtgggacctgcaaccgccccatagcgcagagtccgggaggctccagccaccgcctctgtcggccccattctctaggtccacagagggtagagacactcgggggaacgtacttttactggggtacggggagccctgccccacggctgtcagctcgggtcgggcgcgccgggtgcccaggaggcagcctcccaccctcccccgcacacgtcgttccagtccctccgccacaaagagaccattgattgggaagagcggccgggttgtggtaggaaggctggtggggacacgcacgcacacacacgcgcgcacacagaggcatacacacacacagaggcacacacgcacacacagaggcacacgcacacacaggcacacacacacagaggcacacacaggcacacacacacagaggcacacacacacacagaggcacacacaggcatacacacacagaggcatacaggcacacacacccagaggcacacacatgcgcacacacagaggtgcacacacccagaagcacaagcacacatatacagaggcacacacacacagaggcacacacacgcacagaggcacacacagaggcgcacacacacacacagaggcacacacaggcacacgcgcacacacacacagaggcacacacacatgcacacgcgcacacacacacagaggcacacacaggcacacgcgcacacacaggtacacacagaggtacacgcacacatatacagaggcacgcgcacacgcacatgcacacacagaggcacacacaggtacaccccgcctcctgccgcgcctgacactccgcagggcccgggggtgggtgggcaggggtgcgagggggcgtggggctgggcgcgccggcctggggggaaagccccgcctcccggatgtcgtctcttcgccccctactagctcttgtctcctccccaacccctcgccccaccccctgcctaatttttgccagtggatcatcggcctttggatgaatccgcagcaaatggctcattcggggcgggcccgcctccccatccccccagtgtgcggtctcctctccccagcaaagatgttcggtggcacttacggcccctttttaacaccaggcgaagccaatattgttaggaaggaagaactgctgtggcagctgctgcaaagacaaatcatatgcagtaatgcatcacgggctgagggagggtctgagtgtgcggcagggcagcgcgggcttatcagcgcggaatggctaatgggggcgcggctcccagcggaaggagggctggaaactgtgcgcggtgcggcgaggagaggagaaggccagggcaggagagtttaggcagcaaggattttcgcaatctctcttcttatcctacccctaaaaggaagctgcttggacctgaaggtggagctgaatttgagcctttgctggaggtggggtgcccggcccttctacaaacgcctgcttgattccctccgtgatgggcaaaggccttccctcccacaacacctgaattctgggcaccctgatctttggaggccaggactttcctaggttccctatcagtccacgcacatcagaagtagaacgaacaccctactatctaacccgttcctggctcctgcccccagccctgcctcgtagctggcctgtggtgggtggggtgtggctggcagttggtacccgttaaaagagagctaggagtgatatctacttggtacctccctcaaagctcccgctcgccacctggatgcctgtatgcacacaggaattggctgggggccggggagagcatgggtgggggtgctggtttgcttggtttataacacttcttcttgctcctcaatgccagggcagagagtgtgcccctgtacatgcatccttatttgtgggcaaggctccgtccatgcaggtgcctggagatgtgggtttactcacacattcccaggctctcagggttggaagggactttggaagaggccttccccctcctccctcacctgttctgccatatccatgccaaatgctcatctggattctgcttgatcactcccagtgactggaagctcacttcttccccaggcagcccatctctgctgactgctggaatactgagctggaaactgtgccagcaacctggacaattccccaccccctatcccatctgcatgaaaacgggaccaggacaagatgccaaaaacacagcaccctaagatagttacagctcatgcttacagaatacctccttagccaggcactgtactaagtgctttacgtatcttgactctcataatcttcatgaaactctatgaggtcatgtttgttgttatccccattgtgttgaaaagaaaaccgaggcacagagaagttaagacacttgtctgaagtcccacagcgaggaggtggcaacgcctgttatacaatcaggaagcctggctctgcctgagtttaatcaccacattatattgcaggcactgccgagagagagagagagagagagagagagagagcgagagagagagagagagagagagagagagagagagagagagagagagagagagagagagagagagagagagagagagagagagagagagagagagagagagagagagaaagacacagagagagcaagtaagaatgctcaggcatgagtgtgtatcttcaccaccatttctgggaagcagagctcactggtgttagaggcaactgggaagactggatatgaaattaagacatcaggaattgcctttcttcttcctcctccccaccttttccttc

SEQ ID NO: 55 - DNA, 5001 bp, Homo sapiens
aatctgtaaacagatattagtgagcacattgaggcctatggtgaaaaaggaaataccttcacataaaaacctgaccgaagcattctgagcaactgctttgtgatgtgtgccttcatctcactgagttgaacctctcttttgattgagcacatcggaaacaatctgtttctagaatcagcaaagggatgtttggagcactttgaggcctatgttgaacaaggaaatatctccacataaaaactagtccaaagctttctgagaaacttctttgtgttgagtacattcatctaacagatttgatactttcttttgatggagcagttaggtaacagactttttgtaaaatctgaaaaggaatatttggagcactttgataagctatttgataagctggcttatcaaatttgataagccgtttcaaagctatctttttttaggatctgcaaagggatatttgtgagccctttgaggcctgtggtgaaagaggatatatcttcacataaaaactagatagaagttttctgagaaacttctttgtgttgtgtgttttcatctcacagagatgagcttttcttttaattgagcaatttggaaatttttttttgtagaatctgcaagtgtatatatttggagcactttgaagcctatggtgaaaaatgaaatatcttcacataaatactagacagaagtattctgagaaacttctttgtgatgtgtgaattcatctcacagggttgaacttttcttttgattgagcagtttggaaacagtctttttgcagaatctgcaaaacgatatttgtgagctctttcaggcctatggaaaaatagggaatatcttcacataaaaactagacagaagttttctgacaaacttctttgtgatgtgtgcattcatctcacagagtttgaacgtttcttttgattgtgcagtttggaaacagtctttctgtagaatctgaaatgggatatttggatcgttttatggcatattgtgaaaaaggaaatatcttcacataaaaactagagagaagctttccgagtaacttctttgtgatgcatacattcatgtcacagagttgaaaatttattttgattgagaagtttggaaacattctttttgtagaatttgcaaacagatatttttgagtgctttcagtcctatgttgaaaaaggaaatatcttcacataaaaactagatagaagcattctgagcaaatatttttgatgtgtgcattcatctcacagagttgaacctttcctttcattgagcacttcgagaagagtctgttagtagaatctgcaaagggatatttcgagcactttgaggtctattgtgaaaaatgaaatatcttcacataaaaactagaccgaagctttctgaggaacttctttgtgatgtgtgctttcatctcacagggttgaactttttttttgattgagcagtttggaaacagtctttttgtagaatctgcagagggatatttgtgagccttttgaggcctacagtgaaaaaggaaatatcttaatataaaaactggacagaagctttctgagaaacttctttgtgatgtgtactttcatctcacacagttgaaccattccttcagttgatcagttgggaaacagtctttttgtacagtctgcaaaggaatatttgaagccctttgagtcctatggtaaaaaaggaaatatcttcacataaaaactggatagaagctttccaagaaacttctttgtcatgtgtgctttcttctcacagagttgaacgattcttttgattgatcagtttggaagcactgtttttgtagaatctgcaaagggatattaggagcaatatgaggcctatggttaaaaaggaaatatcttcacatacaaactagacagaagctttctgagaaacttctttgccaggtgtgcattgatctcacaaagttgaacatttcctttgattgagcagtttggaaacattctttttgtaaaatctctaaagggatatttagagcaatttgaggcttatggtgaaaaatgaaatatcttcaattaaaaaatagacagaagcttacagagaaactactttgagatgtgtgcattcatcttgcagagtggaaaatttcttttgattgagcattttggaaacagtctttttgtaggatctgcaaagggatttgtgtgagccctttgagtactacggtgaaaaagaaaatctcttcacatataaactacacagaatatttctgagaaagtccttagtgatgtgagctttcatctcacagagttgaaccattcttttgatagatcagtttggaaacagtctttttatagaaactacaaaaggatatttggagcactttgaggcctatcgtgaaaaaggaaatatcttcacatataaactagacaaaagctctctgagaaacttctttgtgatttgtccattcatcttatatatttaaaccattcttttgattgagcagtttggaaacagtctttttgtagaatctgcaaaaggatatttttgagtggtttgaggcctatggtgaaaaaggaaatattttcacttaaaaactagacagaactttcctgacaaacttctttctgatgtgtgcatttatctcacagagttgaaagtttctattgattgagaagtttggaaacagtctttttatataatctgaaatggatatttggagtgctttgaggcatttggtgaaaaaggatatatcctcacataaaaactagacaaaagctttctgagaaacttctttgtgacgtgtgcattcatttcacacagttgaacatttcttttgactgagcaggttggaaacgtctttttgtagaatctgcaaacagatatttgtgagtgctttgaggcttatggtgaaaaaggaaatacctccaaataaaaacctgacggaagcattctgagcaactgctttgttgcatatgtgtgcattcatctcacagagttgaacctttcttttgattgatcacgttggaaacagtttgtttctaaaatctgcaaagggatatttcaagcactttgaggcctatggtgaacaaggaaatatcttcacataaaaactagatcaaagctttctgagaaacttctttgtgttgagtgcattcatctcacagatttaacctttaatttgataggccattatgaaaccgtctttttttagaatctacacagggatattggtgagcactttgaagcctgccgtgaaaaaggacatatcttcacatgaaaactagacagaagctttctgagcttctttgtgttgtgtgctttcatctcacagtgttgaacctttgttttaattgagcaatttggaaacagtctttttgtagaatctgcaagtgtatatttggagtgctttgaagcctatggtgaaaaacgaaatatcttcacataaatactagacagaagcattctgagaaacttctttgtgatgtgtgaattcatctcagatggttgaacctttccttttattgagcagttttgaaacagtctttttgcagaatttataaagggatatttggagcactttgaagagtatggtgaaaaggaattatcttcacataaaaaatagaagttttctgagaaacttctttgtaatgtgtgcattcatcttacagatttcaacctttcttttggttgagcgtatggaaacagtctttttgtagaatctgcaaaaggatatttgtgagctcttttaggcctatggagaaataaggaatatcttcatataaaaatgagacagaagttttctgacaaacttctttgtgacgtatacattcatctcacagagttgaacatttcttttgatttagcagtttggaaacagtctttctgtagaatctgaaatgcaatatttggatcactttaagatgtatagtgaaaaaggaaatatctccacagagaaactagacagaagctttctgaggaacttctttctgatgtgtgctttcatctcacagaattgaacatttgtttgattgagcagtttggaaacagtgtttttgtggaatctgcagatggatatttgtgggccctttgaggcctatggtgaaaaatgaaatatcttcacataaaaactggacagaacctttatgagaaacttctttgtgatgtgagatttcatctcacagagttgaccattccttcgatttatcagtttggaaacagtctttttgtacaatctgcaaagggatattttgtgcaacttggagcctgtggtgaaaaaggaaatatcttcacataaacactagacagaagctttctgactaacttctttgtggcgtgtgcattcatctcacaaagttgaatgtttctttttattgagcaatttggaaatagtctttttgtagagtctgcaatgggatatttggactgctttgaggcgcatggtaaaaatggaaatgtcttcacataagaattagacagaagcactcgaaggaacttctttgtggcgtgtgcattcatctcacagaggtgaacatttattttgattgagcagtttggaaacagtctttgtgagggatctgcaaacagatatttgttaacgctttgaggcttatggtgaaaaaggaaatgtcttcacataaaaactagtcagaagctttctgaacaacttctttctgatgtgtgcattcatctcacagagttgaacctttcttttgatttagcacattggaaaccatctgtttctagaatctgcaaagagatatttggagcactatgaggcctatggtgaacaaggaaatatcttcacataaaaactagactaatgttttctgagaaacttccttgtgctgagtgcattcatctcacagatttgaatctttcttttgattaagctgtttcaaaaccgtcttttcttagaatctgaaaagggatatttgtgagcccattagggcctgtggtgaaaaaggatatatcctcacataaaaactagatagaagccttctgagaaacttctttgtgttgtgtgttttcatc

SEQ ID NO: 56 - DNA, 5001 bp, Homo sapiens
ctcccagagttgaatctttcttttgattgagcaatttggaaacaatctttttgtagaatctgcaagtgtataatttggaacgctttgaagtctttggtgaaaaaggaattatcttcacataaaaactagacagaagcattctgagaaacttctttgtgataggtgaattcatcacactgagttgtacctttctcttgattgagcaattttgctacagtctttttgcagaatctgcaaaaggatgtttatgagctgttttaggcctatggagaaaaatggaatatctgcacataaaaactagacataggttttctgagaaacttctttgtgttgtgtgcattcatctcacagaggtgaacatttattttgattttgcagtttggaaagagtctttttgaagaatctgcaaacagatatttgtgagcactttgaggcttatggtgaaaaaggaaataacttcacataaaaacatgactgaagcattctgagaaacctctttgtaggggaagcagccaagatggccaaataggaacagctccagtctacagctcccagtgttagtgaagcagaagatgggtgatttctgcatttccatctgaggtaccgggttcatctcagtagggagggccagacagtgggtgcaggacagtgggtgcagtgtaccctgcatgagccaaagctgggagaggaattgactcacttaggaagcacatggggtcagggagttctctttcctagtcaaagaaaggggtgacagatggcacctggaaaatcaggtcactccctccctaatactgcgcttttctgatgggcttaaaaaatggcgcaccaggagattatataccacacatggctcagagggtcctatgcccacggagtctcactgattgctagcacagcagtctgagatcaaactgcaaggcagcagtgaggctgggtgaggggcgcctgccatttcccaggcttgattaggtaaacaaagcagctggaaagctcaaactgggtggagcccaccacagctcaaggaggcctgcctgcctctgtaggctccacctctgggggcagggcacagacaaacaaaaagacaacagtaaactctgtagtcttaaatgtccctgtctgacagctttgaagagagaagtggttctcccagcatgcagctggagaactgagaatgggcagactgcctccacaagtgagtccctgacccctgacccctgagcagcctaactaggaggcaccccacagtaggggcagactgacacctcacacagctgggtactcctgtgagacacaagatccagaggaacaatcagacagcagaagttgcagataatgaaaatctgctgttctgcagccaccgctgatgttacccaggtaaacagggtctggagtggacctctagcaaactccaacggacctgcagctgagggtcctgtctgttagaaagaaagttaacaaagagaaaggacatccacaccaaaaacccatctgtgcatcaccaacatcacagaccaaaagtagaaaaaaccacaaagatggggaaaaaacagagcagaaaaactggaaactctaaaaagcagagcacctctccccctccaaaggaatgcagttcctcaccagcaacagaacaaagctggatggagaatgactttgacaagttgagagaagaagtcttcagatgatcaaactactccaagctacaggaggaaattcaaaccaaaggcaaagaagttgaaaactttgaaaaatatttagacaaacgtataactagaataaccaatgcagagaggtgcttaaaggagctgatggagctgaaagccaaggcttgagaactatgtgaagaatgcagaagtctcaggagcctatgcgatcaactggaagaaagggtatcagtgatggaagatgaaatgaatgaaatgaagcaagaagggaagtttagaggaaaaagaataaaaagaaacgaacaaagcctccaggaaatatgggactatgtgaaaagaccaaatctacgtctgattggtatacctgaaagtgacggggagaatggaatcaagttggaaagcactcttcaggatattatccaggagaacttccccaatctagcaaggcaggccaacattcagattcaggaaatacagagaatgccacaaagataatcctcgagaagaccaaatccaagacacacaattgtcagattcagcaaagttgaaatgaagaaaaaaatgttaagggcagccagagagaaaggtcgggttacccacaaagggaagcccatcagactaacagcagatctcttgggagaaactctacaagtcagaagagagtggggaccaatattgaacattcttaaagaaaagaattttcaacccagaatttcatatccagccaaactaagcttcataagtgaaggagaaataaaatactttacaggcaagcaaatgctgagagacattgtcaccaccaggcctgcccaaaaagagctcctgaaggaagcagtaaacatggaaaggaacaaccagtaccagccactgcaaaatcatgccaaattgtaaagaccatcgaagctaggaagaaactgcaccatctaatgagcaaaataaccagctaacatcataatgacaggaccaattcacacataaaaatattaactttaaacgtaaatgggctaaatagtccaattaaaagacacagactggcaaattggataaagagtcaagacccatcagtgtgctgtattcaggaaacccatctcacgtgcagagacacatataggctcaaaataaaaggatggaggaagatctaccaagcaaatggaaaacaaaaaaggcaggagttgcaatcctagtctcagataaaacagactttaaaccaacaaagatcaaaagagacaaagaaggccattacataatcgtaaagggatcaattcaacaagaagagctaactatcccaaatatatatgcacccaatacaggagcacccagtttcataaagcaagtcctgagtgacctacaaagagacttagacttccccacaataataatgggagactttaacaccccactgtcaacattagacagatcaacaagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaactaaagctcttctcagcaacagtaaaaaatcagaaattataacaaactgtctctcagaccacagtgcaatcaaacgaagaatcaggattaagaaactcactcaaaaccactcaactacatggaaactgaacaacctgatcctgaatgactacagggtacataatgaaatgaaggcagcaataaataaagatgttctttgaaaccaagcagaacaaagacacaacataccagaatctctgggacatattcaaagcagtgtgtagagggaaattcatagcactaaatgctctcaagagaaagcaggaaagatcgaaaataggcacccaaacataacaattaaaagaactagaaaaacaagagcaaatacattcgaaagctagcagaaggcaagaaataactaaaatcagagcagaactgaaggaagtagagacacaaaaaacccttcaaaaaattaataaatccaggagctggttttttgaaaggatcaacaaaattgatagactgctagcaagattaataaagaataaaagaaaaaagaatcaaatagatgcaataaaaaatgataaaggggatatcaccactgatcccacagaaatacaaactaccagcagagtatactacaaacacctctacgcaaataaactagaaaatctagaagaaatggatgaattccttgacacatacactctcccaaggctaaactaggaagacgttgaatctctgaatagaccaataacaggctctgaaatcatggcaataatcaatagcttaccaacaaaaaagagtccaggaccagatggattcacagccgaattctaccagaagtacaaggagtaactggtaccattccttctgaaaatattccaatcaatacaaaaagagggaatcttccttaactcattttatgaggccagcatcatcctgataccaaagccaggcacaaacccacccaaaaatagaattttagaccaatatccttgatgaacactgatgcaaaaatcctcaataaaatactggcaaactgaatccaacagcacatcaaaaagcttatccatcatcatcaagtgggcttcatccctgggatgcaagtctgactcaatatacgcaaatcaaaaaatgtaatccagcatataaacagaaccaaagacaaaaaccacatgattatctcaatagatgcagaaaagtcctttgaaaaaattcaacaaccttcatgctaaaaactctcaataaattgatgggacgtatttcaaaaaaaaaaaaaacaacagctatctatgacaaacccacagtcaatatcatactgaatgggcaaaaactggaagccttctctttgaaaactggcacaagacagatgccctctctcaccactcctattcaacaaagtgttggaagttctgaccagggcaattaggcaggaggaggaaataaaggatattcaattaggaaaagaggaagtcaaattgtccctgtttgcagatgacatgattttatatctagaaaaccccattgtgtcagcccaaaatcttcttaagctgataagtaagcaacttcagcaaagtctcaggatacaaaatcaatgtacaaaaatcacaaacattcttatacaccaataacaggcaaacagagaaccaaatcatgagtgaactcccattcacaattgcttcaaagataataaaatactaagaatccagcttacaagtgacgtgaaggacctcttcaaggagaactacaaaccactgctcaatgaaataaaagag

SEQ ID NO: 57 - DNA, 5001 bp, Homo sapiens
ggatacaaacaaatggaagaatattccatgctcatgggtaggaagaatcaatatcgtgaaaatggccatgctgcccaaggtaatttatagattcaatgacatccccatcaagctaccaatgcctttcttcacacaattggaaaaaaactactttaaagttcatatggaaccaaaaaagagcacgtatctccaagccagttctaagccaaaagctttcatgtgtagaaagctgaaactggatcccttccttacaccttatacaaaaagtaattcaagatggattaaagacttaaacgttagacctaaaaccataaaaactgtagaagaaaacctagactttaccattcaggacataggcatgggcaaggacttcatgtctaaaacaccaaaagcaatggcaacaaaagccaaaattgacaaatgggatctaattacactaaagagcttctgcacagcaaaataaactatcatcagagtgaacaggcaacctacaaaatgggagaaaattttcgcaacctactcatctgacaaagggctaatatccagaatctacaatgaactcaaacaaatttacaagaaaaaaaaaaagcaaccccatcaaaaactgggtgaaggacatgaacagacacttctcaaaagaagacatttatgcagccaaaaaacacatgaaaaaatgctcaccatcactgtccatcagagaaatgcaaatcaaaaccacaatgagataccatctcacaccagttagaatggcaatcattaaaaagtcaggaagcaccaggtgcgggagaggatgtggagaaataggtgggactgtaaactagttcaaccattgtggaagtcagtgtggggattcctcagggatctagaactagaaataccatttgacccagccatcccattgctaggtatatacccaaaggactataaatcatgctgctataaagacacatgcacacatatgtttactacagcactattcacaatagcaaagacttggaaccaacccaaatgtccaacaatgatagactggattaagaaaacgtggcacatatacaccatggaatactatgcagccataaaagatgatgagttcatgtcctttgtagggacatggatgaaattggaaatcatcattctcagtatactatctcaagaacaaaaaaccaaacactgcatattctcactcataggttggaatggaacaatgagaacacatggacacaggaagggaaacatcacactctggggactgttgtgggttggggggaggggggagagatagcattaggagatatacctaatgctaaataacgagttaatgggtgcagcacaccagcatggcacatgtatacatatgtaactaacctgcacattgtgcacatgtaccctaaaacttaaagtataataataataaaataaaaacataaaaagaaaaagaaacctctttgtgacgtgtacattcatctcacaaagttgaacctttctttttatttagcacgttggaaacagtctgtttctagaatctgcaaagggatatttggagcaatatgaggcctactgtgaacaaggaaatatcttcacatgaaaactagaccaaagttttctgagaaacttctttgtgttgagtgcattcgcctggcagatttgaacttttcttttgattaagccatttcaaaaccatcttttcttagaccctgcaaagagatatttgtgagcccaataaggcctgcggtgaaaaaggatatatcttcacataaaaactaaatagaagcttcctgagaaacttctttgtgttgggcgctttcatctcacagagttgaatctttcttcttattgaggaatttggaaaaagtctttttgtagaatcttcaagtgtataatttggagcgctttgaagcctttggtgaaaaaggaaatatcttcacataaaaactagacagaagcattctgagaaatttctttgtgatgtgtgaattcatctcatagagttgtacctttcctttgattgagcagttttgatacagtctttttgtagaatctgcaaagggatatttgtgagctgttttaggcctataaagaaaaagagaatatcttcacataaaaactagacagaaggtttctgagaaacttctttgtgttgtgtgcattcgtctcacagatttgaacttgttttttgattgagctgtttggaaactgtttctgtagaatctgaagtggaatacttagaatgctttgaggcatatagtgaaaaaggaaatatcttcacatataaattagacataagtattctgtgtaacttctttctgatgcatgcattcatctcacagagttgaaactttcttttgattgagcagtttggaaacagtcgttttgtagaatctgctcacagatatttgtgagcacgttgagtcctacggagaaaagggaaatatcttaacatgaaaactagacagaagcattctgagcaacttctatgtgttgtgcgcatttatctcacagagttgaaactttcttttaattgagcactttgaaaagagtctgtttgtagaatcttcaaagggatatttcgagcactttgaggccacttgtgaaaaaggaaatctcttcacataaaaactagaccaaagctttctgagaaacttcattgtgacatgtgcattcctctcccagagttaaaactttcttttggttaagccgtttggaaacagtctttatgtagtacctgcaaaggggtatttttgagccctttgaggtaaatggtgaaaaaggaaatatcttcacataaaaactagacagaagccttcttagaaacttctttgtgatgtgtgctttcatctcacagagttgaacatttcttttaatagagcagtttggaaacagtctttttgcagaatctgcaagtggatatttggaacactctgaggcccatggtaaaaaacgaaatatcttcacataaaagctacacagaaggattctgagaaacttctttgtgatgtgtgcattcatctcaaagagctgaaactttctcttgattgagcagtttcgaagcagtctttttgtagcatctgcaaacagatattcatgagtgctttgaggcctatggtgaaaaaggaaatatctttatacaaaaactagacaaaagcttctgagaaactcctttgtgatatgtggattcatctcacaaagttaaacctctcttttgatggagcaggttggaaagagtctttttgtatgatctgtaagtggatagttggatttcattgaggcctatggtgaaaaaggaaatatcttcacataaaaactagacagaagcattctcagaaacttctttgtgatatattcattcgactctcagagttgaacctttcttttggttgagcagtttggaagcattcgtttttggaatctgcaaagcgatgttttggagccctttgaggcctatagttgaaaaggaactatcttcacatgaaaactagacagaagcattctgagaaacttctttctgatgtgtgctttcatctgacagagttgaacatttcttttgattgagcattttggaaagagtctcttagtagaatctaaaaagggatatttggagtgctttcaggagtatggtgaaaaaggaaatatcttcacctaaaaactagatagaaattttctgagaaacttctttgggacgtgtgcattcatctcacagagttgaacttttcttttgtttgagaggtttggaatcattcttttgtggaatctaaaaagggatatttagagttttttgaggcgtacattgaaaaaggagatatcttcacataagaattagacagaagcattctgagcaacttctttgagatatgtgcactcatctcacagaggtgaatatttcttttgattgagcagtttggaagcagtctttttgtagatctactaaaggatatttctgagcctcttgaggcctatggtgaaaaaggaaatatcttcacatgaaaattacagagaagctttctgagaaacttctttgtgatatgtgctttcatctaacagatttgaatcatttcttgggatgagcgatttggaaacagactttttgtagaatctgcaaaaggatatttgtgagcgttttgaggtatatgatgaaaaaggaaatatcttcacataagaactagatagaaactttctcacaaacttctttgtgatgggtgcatacatctcaaagagacaaatgtttctttttattgagcagtttggaaacagtctttttgcagaatctgaaaagggatatttggatcactttgtcacatggtgaaaaaggaaatatcttcacacaaaaactagacagaagatttctgagaaacttctctgtgacgtgcgcattcatctcacagagttgaacctttctttcgattgagcactttggaaacagtctgttcatagaatctgcaaagggatatttggagaactttgagccctatggtgaaataggaagtatcttaacataaaaactagaccaaagttttctgagaaacttctttctgatgagtgtattcatctcacagagttgaacctttcttttgattgagcagtttagaaacagtctttttgtagaatctgcaaaaggatatttgtgagctgtttgaagcctatggcggaaaaggaaacatctttggataaaaacaagaaagaagttttttgacaaacttctttgtgatgtgtgcatttattgcacagatgtgaacgtttcttttgattgagcagtttggaaatggtctttttgtagaatctgaaaagggatacttggagcgctttcaggcgtatggtgaaaaaggaaatatcttcacataaaaactagaaagaatctttctgagaaacttctttctgacggttgcattcatatcacagagttgaaattttctgttgtttgaacagtttggaaatcctctttttgtattatctggaaacagatatttgtgaacactatgaggcctatggtgaaaatggaaatatttt

SEQ ID NO: 58 - DNA, 5001 bp, Homo sapiens
tcacataaaaactagaaagaagcattttgtaccacttctttgtgatgcttgcattaaactcacacaggtgtagctttcttttgattaagcactttggaaacagtccatttttagaatgcgccaagggatatttggagtactttgaggactgtggtgaaaaaggaaatatcttcaaataaaaaccagatcaaagctttctgagaaacttctttgtgatgaatgcattcatctcacagagctgaactttcttttgattgaggcgtttggaaacagactttttgtagaatctccaaagggatatttgtgagccctttgaggactatggcaaaaaaggaaatatattcccatgaaaactagatagaagctttctgagaaccggttgtgtggtgtgttctttcatctcacagagttgaaccttttgtttgattgagcagtttggaaacagtcttttgtataatctgcaagtggatgtttggagtgctttgaggcctatggtgtaaaagaaaatatcttcacacaaaaattagacagaagcattctgagaaacttcttagtgatgtgtgcatacatctcatacagttgaaactttctttttattgagcagtttgtaaacagtctttttgtagaatctgcaaagggataattttgagccctctgaggtctatggtaaaaaaggaaatatcttcacataaaaactggacagaagctttctaagaaacttatttgtgaagtatgctttcatctaacagagttgaaccattctttcaattgatcagtttggaaacagtctctttatagaatctacaaagggatatttggagcaatttggggactccggtgaaaaaggaaatatcttcacctaaaaactagacagaagctttctgagaaactcctttgtgatgtgtgcactcatctcacagagttgaatgtttcttttgattgtgcagtttggaaacagtctttttgtcaaatctgaaaagggatatttggaatgctttgaagcgtatggtgaaaaaggaaatatcttcacataaaaactacaaagaagctttctgagaaagttctttgtggtttctgctttcatctcacagagttgaaccattcttttgatagatcagattggaaagtgtctttttgtagaatgtccaaagggatagttggagcaccttgtgtcctatggagaaaaaggcaatatcttcacataaaaactagagataagctttgtgagaaacttctttatgatgtgtgcattcatctcacagatttaaatctttgttctgattgggcaggttggaaacagtatttttgcagaatctgcaaaaggatatttgtgagttgtttgaagcctatggtgaaaaaggaaatatcttcacataaaaaccagacagaagctttcggacaaactactttgtgatctgtgcgttcacctcatagagtggaacgtttcttttcaatgagcagtttggaaacaatctttttgtagaatctgaaaaggggtatttggattgttttgaggtgtatggtgaaaaagaaaatatcttcacataagaactagatagaagcattctgagcaacttatctgtgatgtgtgcattcatctctcagaggtgaaactttcttttgattgaggagtttggaaaccatcttattgtagaatctgtaaagggatattggaagcaatttgaggcctaagatgaaaaaggacatatcttcacataaaaactagagagaagcattctgagaaacttctttgtgatgtgtgcattcatctcacagaggtgaacctttcttttgactgtgcagtttggaaacagtctttttgtagaatctcaaatgggatatttggaacatctgcagcgtatggtgaaaaaggaaatatctacacataaaagcaaaacagaatcttttttagacacttctttgtgacgtgtgcatttatctcacagagttgaaactttcctttgattgagcagtttggaaacagtctttttgtagaatctgcaaacagatatttgtgagaacattgaggcctagagtgaaaaaggaaatatcttcacataaaaactagacagaagcattctgagcaactactttgtgatatgtgcattcatctcagagagttgaaattgacttttgattgagcactttggacacagtctgtttgtagaatctgcaaagggatatttggagccctttgagccctgtggtgaaaaaggaaacatcttcaaataaaaacgacaccaagtctttctgagaaacttcttggtgatgagtgcattcatctcacagtgttgaattttcctttgactaggcggttttgaaacagtctctttgtaggatctgcaaagggatgttggtgagccgtttgagacctatggtgaaaaaggaaataccttcacataaaaactagacagaagctttctgagaaacttctttgtgatgtgtgctttcatctcacagagttgaacctttcttttgattgagcagtttgggaaaagttttttgtataatctgtaaagggatatttggagcaatttgaggcatatggagaaaaaggaaatatcttcacataaaaactagacagaagcattctgagaaactacttgtgatgtgtgcattcatctcacagagttgaaactttcttttaattgagctgtttggaaagagactttttttataatctgcaaaagggtatttgtgaggtctttggggcctatggtgaaaaaggaaataacttcacataaaaactacacagaagctttctgagaaagatctttgtgatgtgtgctttcatctcatagagttgaagcaaacttttgatagatcaatttggaaagagtctttttgtagaatctgcaaagggatatttggaacacattggggcctgtggagaaaaaggtaatatcttcacataaaaactagagacatgctttttgagaaaattctttttgatgtgtgcattcatctcacagattcgaatctttcttttgattgagcagtttggaaacagtgtttttgtagaatctgtaaacagatagttgtgaatgctttgaggcctgtggtgaaaaaggaaatatcttcacctaaaaactagacagaagccttctgagcaactacttagtgaagtgtgcattcatctcacagagttgaacatttcttttgattgggcactttggaaacagtctgtttgtagaatctgcaatggtatattaggaggattttgaggcctatggtgaaaaaggaactatcttctcataaacactagaccaaagctttctgagaaacttctttgtgatgagtgcattcatctcacagagttgaaccttccttttgattaagccgtttggaaacaggctatttttagaatgtacagagagatattcgtgagccctttgaggcctatggtgaaatattaaataccttcacataaaaattagacagaagaattctgaaaaacttctttgtgatgggtgctttcatctcacagagttgaaatattctgtcaattgatcagtttggaaacaccctttttgtagaatttgcaaagggatatttggagcactttgagtcttatggtgaaaaaggaaatatcttcacataaaatattgacagaagctttctgagaaactttgtgatgggtgcattcatctcacaaagttgaacctttcttttgattgagcagtttggaaacagtctttttgtagaatctgcaaacagatatttgtgagcactttgaggcccaaggtgaaaaaggaaatatcttcacatagaaaccagacagaagcattctgagcaaattctttgtgatgtgtgcattcatctcacagggctgaacctttcttttgattgagcagtttggaaacagtcttcttgtagaatctgccaaggattatttggagcgctttgaggcctatggtaaaaaaggaaatatcttaacataaaaactagacagaagctatctgaaaaatatctttccatgtgtgcattcatctcacagatttgaaactgtcttttgatttatcagcttggaaacagtctttttggagaatctgccaaggtatatttagagcactttgaccccggcagtcaaaaaggaaatatcttaacataaaaactagacagaagttttgtgggaaacttctttgtgatgtgtgcattctctcacagagttgaaactttcttttcattgagcagtttggaaacagtctttttgtagaatctgcataagtatatttgttagccctttgaggcctatggtgaaaaaggaaataccttcacataaaaactactcagaagatttctgagaaaattctttgtgatgtgtgatttcatctcacagagttgaaacattcttttgatagatcagtttggaaagagtctttttgtagaatctgcaaagggatatctggggcactttgaggcctatggtgaaaaggtaagtatcttcacataaaaactagccagaagcattctgaccaactgctttgtgatgtgtgaaatatctcacagagatgaatcttactttacatggagcactttggaaacagtctttttgtagaatcagcaaagggatatttgtagcaattacaggcctatggtgaaaaaggatatatcttcacataaaaactaaatcaaagccttctgagaaacttctttgggatgagtgcattcatctcacagctttcaatatttgctttgactaagctgcttggaaaaagtcttttgaagaaactgcaaacaggtattttttaaccatttgaggcttatggtgaaaaaggcaatattttaacataaaaactagagagtagctttctgggaaatttctttttgatgtgtgcattctctcacagaatttaaaccttcttttcattgagcagtttctaaacagtctttttttagaatctgcaaagggatatttgtgagaggtttgaggactattgtgtgaaaggaaataccctcacataagaactagacagaagcattctgagaaacttctttgtg

SEQ ID NO: 59 - DNA, 5001 bp, Homo sapiens
gatatgtgcattcatctcacagagttgaatcttgcttttgatttagaagtttggaaacagtctttttgtagaatctgcaaagagatatttctgagccctttgaggcctatggtgagaaaggaaatatcatcgcataaaaactagacagaagctttctcagaaacttattcatgatgtgtgctttcaactcacagatatgaacctttcttttgagtgagcagtttggaaacagtctttttgtagagtctgcaaatggacatttggagcactttgagacctattgtgaaaaacgaaataccttcacataaaaactagacagaagttttctgcaaatcttctttgtgatgggtgcattctctcatgcagttgaaacttccttttgatggagcagattggaaacagcctttttgcagattctgcatagggatatttatgagtcctttgaggcctgcagagaaaaaggaaatatctccacataaaaactacacagaagatttctaagaaagttcttcgtgatgtgtgatttcatctcacagagttgaaccattcgtttgatagatcagtttggaaagagttttttttgtagaatctgcaaagggatatttggagcactttgaggcccatggtgaaaaaggaaatatcttcacataaaaactagacagaagccttctgagaaatttccttgtgatgtgtgcaatcatctcacagatttgaaattttcttttgattgagcagtttggaaacagtctttttgtagaatctgaaaagggatattttgcacactttgtggcgtacagtgaaaaaggaaatatcttcacataaaaactagacaatagctttctgagaaacttctttgcgacgtgtgcattcaactcacagagttcaaactttcttttgattcagcactttcgaaacagtctattagtagaacctgcaaagggatatttgtgagaagtttgaggcctatggtgagaaaggaaataccttccacattataaccagacagaagctttctttattattattattattattattattattattatttttattattaccgtttaagttttagggtacatgtgcacaatgtgcaggttagttacatatgtatacatgtaccatgctggtgcgctgcacccaccaactcgtcacctagcactaggtatttctcccagtgttatcccgccgccctccccccaccccacaacagtccccagagtgtgatgttcctcttcctgtgtctatgtgttctcattgttcaattcccatctatgagtgagaatatgcggtgtttggttttttgttcttgcgatagtttgctgagaatgagggtttccaatttcatccatttccttacaaaggacatgaactcaccattttttatggctgcatagtattccatggtgtatatgtgccacattttcttaatccagtatatcattgttgaatatttgggttggttccaagtctttgctattgtgaataatgccgcaataaacatacatgtgcatgtgtctttatagcagcatgatttatagtcctttgggtatatacccagtaatgggatggctgggtcaaatggtatttctagttctagatccctgaagaatcaccacactgacttccacaagggttgaactagtttactgtctcaccaacagtgtaaaagtgttcctatttctccacatcctctccagcacctgttgtttcctgactttttaatgattgccattctaactggtgtgagatgatatttcattgtggttttgatttgaatttctctgatggccagtgatggtgagcatttttcatgtgttttttggctgcataaatgtcttcttttgagaagtgtctgttcatgtccttcacccactttttgatggggttgtttttttcttgtaaatttgtttgagttcactgtagattctggatattagccctttgtcagattagtaggttgtgaaaattttctcccattttgtaggttgcctgttcactctgatggtagtttcttttgctgtgcaggagctctttagtttaattagatcccatttgtcaattttggcttttgttgccttgcttttggtgttttagacatgaagtccttgcccatgcctatgtcctgaatggcaaagcctaggttttcttctagggtttttatggttttaggtctaacgtttaagtctttaatccatcttgaattgatttttgtataaggtgtaaggaaggaatccagtttcagttttctacatatggctagccagttttcccagcaccaattattaaatagggaatcctttccccattgcttgtttttctcaggattgtcaaagatcagttagttgtagatatgtggcattatttctgatggctctgttctgttccattgatctcaattaggcaggagaagcaaataaagggtattcaattaggaaaagaggaagtcaaattgtccctgtttgcagatgacatgattgtatatctagaaaaccccattgtctcagcccaaaatctccttaagctgataagcaacttcagtaaagtctcaggatacaaaatcaatgtgcaaaaatcacaagccttcttatacacaaacaacagacaaacagagagccaaatcatgagtaaactcccattcacaagtgcttcaaagagaataaaatacctaggaatccaacttacaaaggatgtgaatgacctcttcaaggacaactacaaaccactgctcaaggaaataaaagagggtacaaacaaatagaaacacattccatgctcatgggtaggaagaatcaatattgtgaaaatggccatacagcccaatgtaatttatagattcaatgccaaccccatcgagctaccaatgaccttcttcacagaattggaaaaaactactttaaagttcatatggaaccaaaaaagagccctcatccccaagtcaatcctaagccaaaagaacaaagctggaggcatcacactacctgacttcaaactatactacaaggctacagtaaccaaaacagcaaggtaacggtagacagaagctttctgagaaacttctctgtgatgggtactttcaactcagagatttgaagctttttttgattcagcaacttggaaacagtctttttgttgaatctacaaaaggatatttgtgagcactttgaggcctaggcttaaaaaggaaatatcttaacataaaaactagacagaaggtttctgagaaacttatttctgatgtgtgctttcacctcatggagttgaacctttcttttgatggagcattttggaaacagttttttgtagaatctcgcagtggatatttggagcgctttgggtcctatggtgaaaaaggaaatatcttcacataagaactagaaagaaactttttgagaaacttctttgtgatttgtgcattcatctcacagaggtgaacctttcttttgattgagcagtttggaaacagtcttcttgtaaaatctgcccagggatatttgtgagccctttgaggcctatggtgaaaaagcaggtatcttcacattaaaaatagacagaagctttctgagaaacttctttgtcatgtgtgtattcatctcacagggctgaacctttcttttgattgagcagtttggaaacagtctttttgtagaatctgccaaggaatatttggagcgctttgaggcctacggtgaaaaaggaaatattttgacataaaaacttgacagaaactatctgaaagatgtttgtgatatgtacattcatgtcacagagttgaaactgtcttttgattgaacagtttggaatcagtctttttgtagaatctgtcaagtgatattttgagcgctttgactactgtagtgaaaaaggaaatgtcttaacagaaaaactagacagaaacttttggggaaacttctttgtgatgtgtgcattctctcacatcacagggttgaaactttcttttgattgagcagtttggagacagtctttttgtagaatctgcaaaagtatatatgttaaacctttgaggcctatggtgaaaaaggaaatatcttcacagaaaaactacacagaagctttctgagaaaattctttgtgatgtgtgatttcatctcacagagttgaaacattcttttgatagatcagtttggaaagagtctttttgtagaatctgcaaagggatatctggagcacttagaggcctatggtgaaaaagtaaatatcttcacataaaaactaaccagaagcattctgaccaacttctttgtgatgtgtgcaatcatctcacagagatgaaccttattttagatggagcacttaggaaacagtctttttgtagaatctgcaaagggatatttgtagcaattacaggcctatggtgaaaaaggatatatcttcacataaaaactaaacctaagtcttctgagaaacttccttgtgatgagtgcattcatctcacagtgttcaaaatttgctttcattaaaccacttggaaacagtctttttgtagaatgtgcaaagggatattttttagctctttgtcgcctatggtgaaaaaggaaatatcttcacataaaaactagacagaatttttctgagaaacttctttgtgatgtgtgctttcatctcacagagttgaaccattcttttgatagatagtttggaaacagtgtttttgtagattctgaaaagggatatttgaagcagtttgaggcctatagtgataaaggaaatatcttcacataaaaactagacagaagctttctgaaaaacttcattgtgatgtgtgcattctctcacagagttgaacatttcttttgattgagcagtttgttaacagtctttttgtagaatctgcaagaggatatttgttagccctttgaggcttataatgaaaagggaaatctcttcacataaaacatacaaagaacctttctaagaaagttctatgtgatgcgtgcattcatcttgcagattggaaagtttcttttgattgaccagttt

SEQ ID NO: 60 - DNA, 5001 bp, Homo sapiens
tggaaacagtcttattgtagaatctgaaaagggatatttggagcactttgagacctatggtgacaaaggaaatatctttatattaaaactagacaaaggctttctgagaaacccctttttgttgtgtgcattcatatcacagagctggacgattcttttgattgagcagtttggaaatagcctttttgtagaaactgcaaagggatatttggtagaggtttgaggcctgtggtgaaaaaggaaatatcttcacataaaaactagacagaagctttctgagaaacctatttgtgatgtatgcattcatctcagagagttgaaattatcttttgattgagcagtttggaaaccgtctttttgtagaatctgtaaagggatatttggacaaatttgaggcctatggcgaaaaaggaaataccttcacataaaaactagacagaagcagtgtgagaaaattctttgtgacttgtgcattcatctcatagagttgaacatttcttctgattgagctgttttgaaacagtctttttgtagatctacagagggatatttttgagccctttgaggcctatgttgaaaaaggaaatatcttcacataaaaactacacagaagctttctgagaaagtcatttgtgatgtgtgctttcatctcacagagttgaaacattcttttgatatatcagtttggaaacagtctttttgtagaatctgcaaagggatatttggagaactttgaggactatggtgcaaaaggaaatatcttcacataaaaactacacagaaccattctgataaacttctttgtgaagtgtgcattcatcttgcaaagtttcttttgtctgaagaatttggaagcagtctctctgtagaatctgaaaagggaaatttggagtgctttgaggcatatgataaaaaaagaagtatcttcacataaaaactagaccaaagctatctgagaaacttctttgtgatgagtgcattcatctcacacagatgaatctttatattgattaagccattggaaacaatctttttgtagaaactgcaaaggaatatttggagaacttcatgcctttggtgaaaaatgaaatttcttcacataaaaactagacagaagctttctgagaaacttctttgtgatgtgtgcattcatctcacagagttgaaactttcttttgattcagcgctttggaaacagtctgtttgtgtaatctgcatggggatattttgagcactttgaggtctatggtgatgaaggaaatatcttcacataaaaactagaccaaagatttctgagaaacttctttgtgatgagtgcattcatctcacaaagatgaattttcttttgattaagacgtttggaaacagtctttttgtagagttcgcaaaggcatacttggagcaatttgacacctatggtgaaaaaagaaatatcctcacataaaagctagacagaagctttctgagaaacttctttgtgatgtgtgccttcatctcacagtggtgaaattttcttttcattgagcagctgggaaacagtctttttgtagactgtaaagggatatttggagcaatttgaatcctatcgtgaaaaaggaaatatcttcaaataaaaactagacagaagctttctgagaaacctctttgtgatgtgtgcattcatctcacagagtggaacccttcttttgattgagaagtttggaaacagtctttttgtagaatctgtgaagcgatatttggagtgctttgaggtgtaaggtaaaaaaggaaatatcttcacataacaactagacagaaacattctgagcaactttgtgtgatgcatgcattcatctcacagagttgaacctttcttttgatcgagcagtttgaaaacaatctttttgtataatttgtaaagggatatttggagcaatttgaggcctatggtgaaaaaggaaatatcttcacataaaaactagagagaagaattctgagaaacttctttgtgaattgtgcattcatctcacagatttgaatgtttcttttgattgagcagtttggaaacagtctttttgtagaatctgcaaaaggatatttctgagtggtttgatgtacacggtgaaaaaggaaacatcttcacataaaaattagacagaatttttctgacaaacgacttcatgatgtgtgctttcacctcagagatttgaacgtgtcttttgaatgagcagttttgaaacagtctttttgtagaatatcaaatggtatatttgaagtgctttgaagcacctggtgaaaacggaaatatcttcacattaaaacaagacggaatctttctgagaaacttctttgtgacgtgtgcattcatctcagagagttgaacatttcttatgattgagcagtttggaaagagtctttttgtagaatctgcaaacagatagttgtgagcggtttgaggcttatggtgaaaaaggaaatatcttcacaaaaaaactagacagaagctttgtgacaagctactttgttgcgtgtgcattcatcttacagatttgagtgtttcttttgatagagcagtttggaaacagtctttttgtagaatctgaaatgggatattaagagtgctttgagacgtatggtgaaaaagggaatatcttcatataaaagctagacagaagctttctgagaaacttctttgtgatgtgtgcattcacctcacagagttgaacgtttcttttggttgagcagtttggaaagagtctttttgtataatctgaaaaggatatttggagtgctctgaggcatatggtgaaaaaagaagtatcttcacataaaaactggacagaagcattctgagaaacttctttgtgatgtgtgcattcatctcacagagttgaaccttgcttttaattgagcactttggaaacagtctgtttgtagtatctacaaaggcaaatttgtgagccctttgaggacgattttgaaaaggaaatatcttcacatgtaaaccacacagaagcattctgagaaagttctttgtgatgtgtgttttcacctcacagagttgaaccattcttttgatagatccatttggaaacagtctttttgtagaatctgcaaactgatatttggagcactttgagatgtattgtgaaaaaggaaatatcttcacagaaaagctagacagaagctttctgagaaacttcgttgtgatgtgtgcattcatctccaggtgttgaacctttcctttgattgagcagtttgaaaagagtctttttgtaaaatctgcaaacagaaatttgtgagccttttgtcgcctatggtaaaaaaggaaatatcttcacataaaaactgaacagaagctttctgagaaacttctttttgatatgtactttcatcccacagtgttgaactattctttcaattgatcagtttggaaacagtctttttggaatatctgcaaagggatgtttgccacaattttaggcttacagtgaaatagggaaaatcttcatataaaaagaagacagaagctctctgagaaacttctttgtgatatgtgcattcatctcacagagctgaacatttcttctggttgagcagtttggaaaccgtctttttgaagaatctgcaaagggatatttggagcaatttgatgcctatgttgaaaaaggaaatatcttcccataaagactacacagagctttctgagaaacttctttgtgatgtgtgcattcatctcacagagttgaacctttcttttgattcagcactttttttttttttttttttttttttttgagacggagtctcgctctgtcgcccaggccgcactgcggactgcagtggcacaatctcggctcactgcaagctccgcttcccaggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccatgattcagcactttggaaacagtctgtttgtgtgatctgcctggggatatttggagcacttttaggtctatggtgaaaaagaataaatctttacataaaaactagaccaaagctttctgacaaacttctttgtgatgagtgcattcatgtcacaaagatgaacttttcttttgattaagccatttggaaacagtctttttgtggagtctgcaaaggcatacttggagcaatttgaggtctacggtgaaaaaagaaatatcttcacataaaaactcgtcagaagctttctgagaaacttatttgtgatgtgcacattcatctcacagccgtgaaactttctttttattgagcagcttggaaacagtcttttcatagaatctgtaaagagacatttggagcaatttgaggcttattgtgaaaaaggatatatcttcagataaaaactagacagaagctttctgagaaacttctttgtgatgtgtgcattcatctcacagagctgaatgcttcctttgattgagcagtttggaaacagtctttttgtagaatctgcaatgcgatatttggagtgctttgaggcataaggtgaaaaaggaaatatcttcacataacaactagacagaagcattctgagcaactttgtgtgatgtgtgcattcatctcacagaggtgaaactttcttttgattgagcagtttggaaacagtctttttgtataatttgtaaagggatatttgaagcaatttgaggcctattcaccaaaggaaatatcttcacataaaaactagagagaagcgttctgagaaacttctttgtgaatttgcattcaactcacagatttgaacctttcttttgattgagcagctttgaaacagactttttgtagaatatgaaatggtatattttgagtgctttgaggagcttcgtgaaaaatgaa

SEQ ID NO: 61 - DNA, 5001 bp, Homo sapiens
aatatcatcacattaaaacaagacggaatctttctgagaaacttctttgtgatgtgtccattcatctcagagagttgaacatttcttatgattgagcagtttggaaagagtctttttgtagaatctgcaaacagatagttgtgagcagtttgaggcttatggtgaaaaaggaaatatcttcacataaaaactagacagaagctttgtgacaaactagtttgtgatgtgtgcattcatcttacagagttgaaagtttcttttgatagagcagtttggaaacaatctttttgtaaaatcagaaatgggatattaggagcgctttgaggagtatggtgaaaaaggaaatatcttcacataaaaactagaccgaagctttctgagaaacttgtttgtgatgtgtgcattcatctcacagatttgaaccttccttttaattaagcagtttggaaacagtctttttgtagaatctgcaaagggacatttgggagccctttgagacctttgctgaagaagaaaatgtcttcacataaaaactggacagaaactttctgacaaactcctttgtgatgtgtactttcatctcacagagttgaaacgttcttttgatagatcagtttggaaacagtgtttttgtagaatctgcaaagtcatatttggagcaatttgaggctgatggtgaaaaaggaaataccttcacataaaaactagacacagagggaggagtcaagatggccgaatagcaacagctctggtctacagctcccagcatgagtgatgcagaagatgggtaatttctgcatttccatctcagtttccttgttcatattactggggtgtgctagacagttggtgcatgatgctgggtgcagtgcaccgtgcatgagccaaagcagggcgaggcattgcctcacccaggaagtgcaaggggtcagggaattccctttcctagtcaaagaaaggggtgacagatggcacctggaaatcgggtcactcccaccctaatactgtgccttcccaatgggcttaaaaaacggcacaccaggagattctatcctgcacctgtcttagagggtcctaaacccaagaagtctcactcactactagcacagcagtctgaggtcaaactacaaggtggcagtgaggctgcgggaggtgtgcccaccattgcagagacttgattcggtaaacaaagcagccgagaaactcgaactgggaggaccccaccacagctcaagaaggcctgcctgcctctgtaggctccacctctgggggcagggcacagacaaacaaaaagacagcagtaacctcggaagacttaaatgtccctgtctgacagctttgaagagagtagtggttctcccagcacacagcttgagatctgagaatgcgcagactgcctcctcaagtgggttcctgacccctgagtagcctaactgggaggcatcccccagttaagggtggactgacacctcacacggccgggtactcctctgagacaaaacttacagaggaaagatcaggcagcagcatttgcagttcaccaatatccactgttctgcagccaccactcctgacacccaggcaaacagggtctggagtggacctccagcaaactccaacagacctgcagctgagggccctgtctgttagaaggaagactaacaaacagaaaggacatccacaccaaaaactcatctgtacgtcaccatcatcaaagaccaaaagtagataaaaggacaaagatggggaaaaaacagagcagaaaaactggaaactctaaaaatcatagcccttctcttcctacaaaggagctcagctcctcaccagcaatggaaaaaagctggatggagaatgactgatgagttgagagaagaaggcttcagatgatcaaactactctgagctacaggaggagattccaaccaacggcaaagaagttaaaaacttggaaaaaattagaagaattgataactagaatagccaatgcatagaagtccttaaaggacctgatggagctgaaaaccaaggcacaagaactacgtgacaaatgcagaagcctcagtagctggtgcaatcaactggaagaaaaggtattagcgatggaagatgaaatgaatgaaatgaagtgagaagagaagtttagagaaaaaagaataaaaagaaatgaaaaaagcttccaagaaatatgggactatgtgaaaagaccaaatctacatcagattggtgtacatgaaagtgacagggagaatagaaccaaattggaaaacactctgcaggatattatccaggggaatttccttaatctagcaaggcaggccaacattcaaattcaggaaatacagagaaccccacaaaggtaatcctggagaagagcaactccaggatacataattgtcagattcaccaaatttgaaatgaaggaaaacatgttaagggcagccagagagaaaggtcgggttacccacaaagggaagcccatcagactaatagtggatctcacagcagaaactctacaagacagaagagagtggggaccaatattcaacattcttaaagaaaagaattttcagcacagaatttcatatccagcaaaactaagcttcataagtgaaggagaaataaaatcctttacagacaaacaaatgctgagagattttgtcaccaccaggcctgccctaaaagagatcctgaaggaagcactaaacatggaaaggatcaactgctaccagccactgcaaaaacatgccaaattgtaaagaccatcaaggctaggaagaaactgaatcaactaaagagcaaaataaccagctaacatcataatgacaggatcaaattcacacaaaacgatattaactttgaacgtaaacgggctaaatgctccaattaaaagacacagactggaaaattggatagcgtcaagacctgtcagtgtagtgcattcaggaaacccatctcacgtgcagagacacacataggctcaaaataaagggatggaggaagatctaccaagcaaatggaaaacagaaaaaggcaggggttgcaatcctagtctctgataaaacagactttaaaccaacaaagatcaaaagagacaaagaaggccattacataatggtaaagggatcaattcaacaagaagagctaactatcctaaatatatatgcacccaatacaggagcacccagattcataaagcaagtccttagagacctacaaagagatgtagactcccacacaataataacgggagtccttaacaccccactgtcaaattagacagatcaacgagacagaaagttaacaatgatacccaggaattgaactcagctctaaagcaagcggacctaatagccatctacagaactctccactccaaatcaacggaatatacattcttttcagcaccacacatattctaaaattgaccacatagttggaagtaaagcactcctcagcaaacgtaaaagaacagaaattataacaaactgcctctcacaccacagtgcaatcaaactagaactcaggattaagaaactcactcaaaacctctcaactacatggaaactgaataacctgctcctgaacgactactgggtacataatgaaatgaaggcagaaataaagatgttctttgaaaccaacgagaacaaagacacaacataccagaatctctgggacacattcaaagcagtgtgtacagggaaatttatagcaccaaaggcccacaagagaaagcaggaatgatctcaaattgacaccctaacatcacaattaaaagaactagaaaagcaagagcaaacacattcaaaagctagcagaagaaataactaagatcagagcagaactgaaggaaacagagacagaaaaaacccttcaaaaaattaatgaatccaggagctggtttttgaaaagatcaacaaaattgatacacctctagcaagactaataaagaagaaaagagagaagaatcaaagagatgcaataaaaaatgatagaatcaaatagatgcaataaaaatgataatggggatatcaccactgatcccacagaaatacaaactaccatcaaagaatattataaacacctctatgcaaataaactagaaaatcttgaagaaatggataaattcctccacacatacactctcccaagactaaaccaggaagaagttgaatctctgaataaaccaataacaggctctgaagttgaggcaataatcaatagcttaccaaacaaaaaaagtccaggaccagatggattcacagccgaattctaccagaggtacaaggaggagctggtaccattctttctgaaactattccaatcaatagaaaaagagggaatcctccctaactcattttttgaggcgagcagcatcctgataccaaagcctggcagagacacaaccaaaaaaaagaattttagaccaataaccttgatgaaaattgatgcaaatatcctcaataaaatattggcaaaccgaatccagcaggatatcaaaaagcatatccaccatgatcaagtgggcttcatccctgggatgcaaggctggttcatcatacataaatcaataaatgtaatccagcatataaacagaaccaaagacaaaaaccacatgattatctcaatagatgcagaaaaggcctttgacaaaattcaacaactcttcatgctaaaaactctcaataaattaggtattgatgggacgtatctcaaaataataggagctatctatgacaaacacacagccaatatcatactgaatgggcaaaaactggaagcattccccttgaaaactggcacaagacagggatgccctctctcaccactcctattcaaaagagtgttggaagttctggccagggcaatcaggcaggagaaggaattaaatggtattcaattaggaaaagaggaagtcaaattgtccttgtttgcagatgacatgattgtatatctagaaaacccattgtctcagcccaaaatctccttaagctgataagca

SEQ ID NO: 62 - DNA, 5001 bp, Homo sapiens
aaattcagcaaagtctcaggatacaaaatcaaggtacaaaattcacaagcattcttttacaccaataacagacaaacagagagccaaatcatgagtgaactcccattcagaattgcttcaaagagaataaaatacccaggattccaacttacaagggatgtgaaggacctcttcaaggagaactacaaaccgctgctcaatgaaataaaagaggatacaaacaaatggaagaacattcctttctcatagataggaagaatcaatatcatgaaaatggccctactgcccaaggtagtttatagattcaatgccattcccatgaagctaccaatgactttcttcacagaattggaaaaaactactttaaagttcatatggaactaaaaaagagtccacaatgccaagtcaattctaaccctaaagaaaaaagcggaaggcatcaagctgcctgacttcaaactatattataaggctacagtaaccaaaacagtctggtactggtacctaaacagagatatagaccaatggaacagaatagagccctcagaaataatgccacatatctataactatctgatctttgacaaacctgacaaaaacaacaaatggggaaaatattccctatttaataaatggtgctgggaaaactggctagccatatgtagaaagctgaaactggatcccttccttacaccttatacaaaaattaattcaagatggattaaagacttaaaccttcgacctaaaaccataaaaaccctagaagaaaacctaggcaataccattcattacataggcatgggcaaggacttcatgtctaaaacatcaaaagcaacggcaacaaaagccaaaattgacaaatgggatctaattaaactaaagagcttctgcacagcaaaagaaactgccatcagagtgaacaggcaacctacaaaatgggagaaaatttttgcaaactactcatttgacaaagggctaatatccagaatctacaatgaacgcaaacaaatttacaagaaaaaaacaaacaaccccatcaaaaagtgggtgaaggatatgaacagacacttctcaaaagaagacagttatgcagtcaaaagacacataaaaaaattctcatcatcactggccatcagagaaatgcaaatcaaaaccacaatgagataccatctcacaccagttagaatggcaatcattaaaaagtcaggaaacaacaggtgctggagaggatgtggagaaataggaacattttacactgttggtgggactgtaaactagttcaacccttgtggaagtcagtgtggcgattcctcagggatctagaactggaaataccatttgacccagccatcccattactgggtagatatccaaaggattataaatcatgatgctataaagacacatgcacacgtatgtttattgtggcactattcacaatagcaaagacttggaaccagcaatggtagagtggattaagaaaatgtggcacatatacaccatggaatactatgcagccataaaaaatgatttcatgtcctttgtagggacatggatgaaactggaaaccatcattctcagcaaactatcggaaggacaaaaaaccaaacacctcatgttctcactcataggtgggaattgaacaatgagaacacatggacacaggaaggggaacatctcacactggggacagttgtggggtgggggtagggggaagggatagcattaggagatatacctaatgctaagtgacaggttagtgggtgcagcacaccaacattgcacatgtatgcatatgtaacaaacctgcacattgtgcacatgtaccctaaaacttaaagtataataaaaataaaataaaataaaaactagacagaagctttctgagaaacttctttgtgatgtgtgcattcatctcacagatttgagcatttcttgtgattgaggagtttggaaacagcctttttgtagtatctgcaaaggggtatttggagtgttttgaggtgtatggtgaaaaaggaaatatctgcatataagaactagacagaagcattctgagcaacttctttgtgatgtgggcatacaacacagagagttgaaactttcgtttcattgagaagttcggaaacagtcttattgtagaatgtgcaaagggatatttttgagccttttgaggcctagggtgaaaaaggaaatatcctcacataaaaagtacacagaagctttctgaaaaactcctttatgatgtgtgatttcaccccacagagttgaaccattctcttgatagatcagtttggaaacagtctttctgtagaatctgcaaagcaatatttggagaactttgaggcctatggtgaaaaggaaatatgttcacataaaaaatagacaggagcattttgagcagcttctttgggatgtgtgcattcatcacaaggagttgaaacattcttttgattgagcagtttggaaaaggtctttttgtagaatctgcaaaaggatatttgtgagtggtttgaggcctatggtgaaaaaggaaatagtttggaaacagccttttttggaatctgttaaggtatatttggtgcactttgaggcctatggtgaaaaagaaatatcttcacataaaaactggacagaagatttctgagaaacttctttgtgatgtgtgcattcatctcacagagttgaaccattcttttgattcatcagtttggaaacagtatttttgcgtaatctgcaaatggatatttggagcaatttgaggcctatggtgagaaaggagatatcttcagataaaaactagaccaaagctttctgagaaacttatttgagatgagtgcatttatctcacagagttgtatctttcttttgattaagtcgtttggaaacattattttgtagaatctgcaaagggatatttgtgagccctctgaagactatgttgaaaaaggaaatattttcacttaaaaactagacagaaaatttctgagaaaactctttgttagtgtgcattcatctcacagagttgaatgtttcttttgattgagcagtttggaaacagtcttttcatggaatctgcaaagggatatttggagtgctttgaggcctgttgtgaaaaaggaaatatcttcacataagaactagacagaagcattgtgagcaacttctttgtgatgtgtgcattcatctcacagaggtgaaactttcctttgattgagcagttgaaaacagtctttttgtagaatctgcaaacagatagttgtgagaggtttgaggcttatggtgaaaagataatatcttcacataaaaaccagacagatgctttctgagcaactgctttgtgaggtgtgcattcatctcacagaagtgaacatttcttttgattgagcagattggaaacactctttctgtagaatctgaaatgagatacttggagcactttgaggcatatggtgaaaaaggaaatatcttcacataaaaactagacagaaactttctgaggaatttatttgtgttgtgtgcattcatctcatagagttgaacattaaactcatccaaagatttgaacattaaactagtccaaagctttcacataaaaactagtccaaagctttatgagaaacacgtttctgatgagtgcattaatctcacatagttgaacctttcttttgattaagccatttggaaacagtctttttctagaatctgcatgggatatttgtgagccctttgaggtctgtggtgaaaaaggtaatatttttacataaaactatacagaagctttctgagaaagttctctgtgatgtgtgctttcatgtcacagagttgaacttttcttttgttgagcagtttggaaagtctttttgtacaatcttcaagtggatgtttggagcgctttcaggccatggtgaaaaaggaaatgtcttcacacaaaaactagacagaaggtttctgagaaacttctctgtgatgtgcacattcatctcagagagctcaacatttcttttgatggagcagtttggaaagagtacttttgtagaatctgcaaaaggataattttgagcagtttgaggcttatggtgaaaaaggaaatatcttcacataaaaaccagacagaagctttctgacaaacttctttgggatgtgggaaatcacctcacagagttgaaggtttcctttaattgagcagtttggaagcagtctttttccagaatctgcaaagggatagttggagtgctttgaggcatatggtgagaaaggaaatatcttcacatgagaactagtcagaaacattctgagcaacatctttgtgatgtgtgcattcatctcacagaggtgaacctttcttttgattgagcagtttggaaacagtctttttgtagaatatgtaaaggggtatttggagaagtttgaggcctatggttaaaaaggaaatatcttcacatgaaaattaccctaaagcattctgagaaagttctttgtgaggtgtgcttgcatctcatagagttgaacctttcttttgaaagatgagtttcataacagtctttttgtagaatctgcaaagggatatttgcagcatttttaggcctatggtgaaaaaggaaatatcttcacataaaaacaagacagaagcttctgagaaacttcttcatgatgtttgcattcctccctcacactttatgctttcttttgactgagcagttggaaacagtctttttgtagaatctgcaaatgaatatttgtgatcagtatgaggcctaaggtgaaaaatgacataccttcaaatgaaaactgaaccaaaactttctgaaaaacttctttgttatgtgtgcattcatctcatggagttgaacatttcttttaattcagcagtttggaaacagactttttgtagaatctgaaaagggatatttggagcgctttgaggtgtatggagaaaaaggaaatatcttcaagtagaaacaagacagaaaccttctgagaaacttctttgtgacatgt

SEQ ID NO: 63 - DNA, 5001 bp, Homo sapiens
tgcattcatctcacagagttgaaactttcttttgattgaccagttgagaaagtctttgtgtactatctgcaaagagatacttgtgagaactttgagggctatggtgaaacaggaaacatcctcactaaaaattagacagaaacattctgagcaacttttttgtgatgtgtgaattcatctcacagaattaaaactttcttttgatggagcactttggatacagtctgtttgtagaatctgcaaagggatatttggaggaacttgaggcctacggtgaaaaaggaaatatcttcacataaaaactagtccaaaggcttttgagaaaattctttgtcatgagtgaattagtctcacagcattgaatctttattttaattaagccatttagaaggagtctttttgtagaatctgcaaagggatacttgtgagcccatggaggcctatggtgaaaaaggatatatattcacataaaaacttgacagaagctttctgagaaacttgtttgtgatgtgtgattaaatctcacagaattcagcctttcctttcattgagcagtttgaaaacagtctttttgtagaatttgcaagtggatatttttagcgctttgaggcctatggtgaaaaaggaaatatcttcaaataaaaactagaaagaagcattttgagcaacatccttgtgatgtgtgcatgcatctccagagttaaacctttcttttgattgagaactttggaaaatttatgtttgtagaatctgcaaagggatatttggagaaatttgaggcctgtggtgaaaaaggaaatatcttcacataaaaactggactgaagttttctgagaaacttctttgtgatatgtgctttcatttcacagagttgaaccattcttttgatttatcagtttggaaacagtctttttgtggaatctacaaatggatatttggagcactttgatgcctatggtgaaaaaggaaatatcttcacataaaaactagacagaagctctctgagaaacttctttgtgatgtgtgcactcatttcatagtgttgaaactttcttttgattaagcagtttggaaacagtatttttgtagaatctgcagcaggatatttatgagctgtttgaggcctatggtgaaaagtgaaatatcttcaaataaaaactagacagaagctttctgaggaacttctttgtgttgtgtgctttcatcttacagagttgaacctttcttttgattgagcagtttgtaaacagtctttttggagaatttgcaagtacatatttgcagggatatgaggcctacagtgaaaaaggaaatatcttcacataaaaaccagacagaagctttctgagaaactcctttttgatgtgtgcattcatctgacagagttcaaactttcttttgattgagcagtttggaaacagtctttttgtagaatctgcacagggatattcatgagtggtttcttgcctgtgttggaaaaggaaatatcttcaaataaaagctaaacagaaaaattccgataaacttctttgtgatgtgtgcattcatctcacagatatgaacctttcttttgattgagcagtttggaaacagtctttttgtagaatatgcaaatggatatttggagtgatttgtggtctatggtgaaaaaggaaatatcatcatataaaacctagacagaagctttctgaggaacttctttgtgatgtgtgcattcatctcacatgtttgaacttttttttgatagagcggtttggaaacagtcttcttgtaccatctgcaaagggatatttctgggcagtttgaggactgtggtgaaaaagaaatatcctcagataaatactagacagaatcattcggagaaacttcttcatgatgtgtacattcaactcacagtgttgaaactttcttttgattaagtgctttggaaacagtatttttgtagtatctgcaatgggatatttgtgagtcctttgagacttatggtgaaatatgaaatatcttcacataaaaactaaacagaagaattcagagaaactactttgtgatgtgtgctttcatctcacagagttgaacctttctttagattgagcagtttttttgaaacagtctttttgtagaatatgcaaatggatatttggatctctttgaggcctatggtgaaataggaaatatctttacttaaacactagacagaagctttctgacaaacttctttgtgatgtgtgctttcgtctcatagagttgaaactttcttttgattgagtagtttggagacagtcttttagtggaatctgcagcaggttatttgtgagcagtgtgaagcctatggtgaaaaaggaaatatcttcacataaatactagactgaagccttctgaggaacttctttttgatgtgtgctttcacctcacagttttgaacgtttcatttgattgagaagtttggaagcagtctttttgtagaatctgcaattggttatttgtgagacctttgaagcttatggtggaaaaggaattatcttcacataaaaactagacagaagctttctgagaaacttctttgtgatgtggtctttcatctcacataattgaacctttatttctttcagcagtttgtaaacagtctttttgtagaatatacaattggatatttggagtgctttgaggcctgtgttgaaaaaggaaatatcttcacttaaaaactagacagaatatttctgagaaacttctttgtgatgtgtgcattcatctcacggagtacaaactttcttttgtttgatcaaattggaaacagtatttttgtagaatacgaacagagatatttgtgagccctttgaggcatatggtgaaaaaggagatatgttcacataaaagctagagagaagatttgtgataaacttctttgtgatgtgtgctttcatctcacaggtttgaacctttcttttgattgagcagtttggaaacagtctttttgaaaaatctgcagcaggatatttgtgagtggtttgaagcctgtggagaaaagatgtatcttcacataaaaactacaaagaagcattctgagaaacttctttgagatgtgtgcattcatctcacagagttgaacctgtcttttcattgagcagtttggaaacagtctttttgtagcatctgaaatgggatatttgtagcactttgtggcttatggtgaaaaaggaaatatgttcacataaaaactagacagaagctttctgaaaaacttctttgtgatatgtgctttcacctcacagagttgaatcattctgttgattgagctgtttgcaaatagtctttttgtagaaactgcaaagggatatttggagcactttgaggcctatggtgaaagaagaaatatcttcatataaaaactagacagaagcattctgagaaacgtctttttgatgtgtgctttaatctcacagagttgaacctttcttttgattgataagattggaaacattctttttgtagaaactgcaaagggatatttggagcactttgaggcctttggtgaaaaaggaaagatcttcacataaaaactagacagaagcattgtaagcaacttctttgtggtttgtgcattcatctcacagaattgaacctctctattgattgagcactttgcatacagtctttttgtaaaatctacaaaggtatatttggagcattttgaggcctgtggtgaaaaatgaaaaatcttcacataaaaactagaccaaactttctgagaagcattttgtgatgtgtgcattcatcccacagatttgaacctttatttgattaagctgattggaaacagtctttttgtagaatatgcaaagggatatttgtgagctctctgaggactatggtgaaaatgaaatatcttcacataaatagtagacagaaactttctgagaaactaccttgtgatgtgtcctttcatctcacagtgttgaacctttcttttgattgagaagtttggaaacagtctttttgtagtatctgcaaagggatatttggagcgctttgagtcgcatggtgaaaatggaaatgtcttcacataaaaactagacagaagcatttgggaaacaactttgtgatgtgtgcattcatctctcagatttgaaactttcttttcattaagcagcttggaaaaagtctttttgtagaatctgcaaagggatatttggagcactttgaggcccatggtgaaaaaggaaatatcttcacataaaaactggacataagcattctgagaaacttgtttgtggtatatgaatttatctcaaagagtagaatctttcttttcattgagcagttcggaagcagtctttttgttgaatcttcaaagggatatttttgagccatttgggcctttgatgaaaaaggaaatatattcacataaaaactagccagaagacttttgagaaagttctctgtgatgtgtggaatcatctcacagagtttaacattacttttgattgagcagtttggaaacagtctttttgtggaatctgcaaagggatatttttgagccctttgaggcctatggtgaaaaatgaaatatcttcacataaaaactagacagaagttttatgaaaaacttctgtgtgatgtgtgcattcatatcacacagttgaatttttcttttgatttagcagtttagaaacagtcttttttgtagaatctgtaaagggatatttgtgagtggtttgaggcctgtggtgggaaaggaaatatcttcccataaaaactagatagaagctttctgagaaacttatttctgatgtgtgcattcatctcacagtgttcaaactttcttttgattgaacagtttggaaacagtcttactatagaatctgccaaaggatatttgtgagctgtttgaggcctacagtgaaaaaggaaatatcttcacataaaaactagacggaagttttctgataaattgctttgtgatgtatgcattcatctcacagatgtaagcattactttccattg

SEQ ID NO: 64 - DNA, 5001 bp, Homo sapiens
gagcaggttgtaaaatctgttcttgtagaatcttcaaagggatttgtttgatcagttagaggcctctggtgaaaaagggaatatcttcacataaaaactagacagaagctttctgagaaacttctttgtgatgtgtgctttcatctcaaagaggtgaacctttttcttttgactgaggagattggaaactctgttcttgtagaatctgcaaagggatatttgtgagccgtctaaggcctatgttgaaaaaggaaatatcttcccataaaaactagacagaagctttctgataacttctttgtgatgtgtgccttcatctcacaaagttgaacctttcttttgattgagcagttgggaaacagtctttttgtagaatctgaaaagggatatgtgtgagtggtttgaggcctctgtagaaaaaggaaatatcatcccataaaagctagacagaagatttctgagcaacttccttgttatgtgtgcattcatctcacagtgtagaatttttcttttcactgagcagcttgttaaccgtcttattgtagaatttgcaaaagggatattttgagctgtttcaggcttatggtaaaaaagttaatatctttacataaaaactagacagaagctttctgagaaacttctttgtgatgtgtgctttcatttcacagagttgaaactctcgttggattgagcagtttggaaacagtcttttagtagaatctgcaaagggatatttgtgatcgttttcatacttatggtgaaagaagaaatatcttcacataaaaaccagacagaagttttctgagaaactagtttgtgatgtgtgcattcatttcacagatgtaaacatttcttttcattgaacagattaaaactgtgttcttgtagaatctgcaaagggatatttgtgagcggtttgatgcctatggtgaaaatggaaatatcttcacataaaaactggacaggtttcagagaaagtgctttatgttgtgttcattcaccacagaggtaaacttttattttcattgagcattttggaaactctgttcttgtagaatctgcaaagggatatgtgtgagcagtttgagggctatggtgaaaaattaaatatcttcacataaatactagacagaatatttctgacaaacttctttgtgatgtgtgcattcatctcgtagagttgaacttatgtttgattgagcagtttggagactgtctttttgtataatctgtcaggggataattgtgagccgtttcaggcctgtggtgaaaaaggaattatcttcacataaaaactaaacagaagttttctgagaaacttctttgtgatgtgtgcattcatctcacagagttgaacctttcttttgattgagcagttttcaaacactctttatagaatctgcaagtggatatttggagtgctttgaggcctatcatggaaaaggaaatatcttcacataaaaactagatagaaacattctgataaacttctttgtgatgtgtgcattcatttcacagagatgaacgtttcttttgatggagcaatttggaaacagtctttttgtacaatctgcacagggacatttgagggtgcattgagacctatggtgaaaaacgaaatgtcttcacaaaagaactggaaagaagttttctcagaaaattcttttcatgtgtgcattcatctctcacagttaaagctttctattgatttagcagtttggaaaccatctccttgtagaatctgcaaagggatatttgtgagccctttgaggcctgtggtcaaaaaggaaatatcgtaacataaaaactagacagaatgtttctgagcaattgctttgtgatatgttcattcaactcacagaggtaatcatttattttcattgagcagattataaactctgctcgtgtagaatctgcaaagggttatttgtggtgctatggggccaatggtgaaaaaggaaatatcttcacataaaaattagacagatgctttctgagaaagttttttgtgttatgtgcattcatctcacagagtcgaccatttgttttgatggagctgtttggaagaagtcttcttgtagaatctggaaggggacattttttatcggtttgaggtctatggtcaaaaaggaaatatcttcacataaaaactagacagaaatttctgagaaacttctttttgatgtgtgcattcatctcacagagttgaacctttcttttgattgagcagtttgaaacattcttttcgtagaatctgaaaagggatgtttgtgagcggtttgaggcctatggtgaaaaaggaaatatcttcccataaaaactagacagaagcattctgagaaactgctttgtgatatgttcattcatctcagagaagtaacatttcttttcattgagcagattggaaactgtgttcttgtagtatctgcatggggatattttagatcactttgaggcctatggtgaaaaagcaaatatcttcacataaaaactagacagaagttttctgagaaacgtctttgttatgtgtgcattcatttcactgtcttgaacctttcttttgattgagcagattggaaacagtctttttgtagaatctgcaaaggaatatttttgagccttttgaggcatatggtgaacaaggtaatatcttcacataaaaactaggcagaatgttttggagaaactgctttatcatatttgcattcatctaaccaagttaaaagtttcttttcattgagtagattcgaaaatctgttcttctgtaatctgcaaagggatatatgtgagctgtttgaggcctatggtgaaaaatgaaatatcttcacatgaaaactagaaagaagatttctgagaaacttctttcttttggctgagcagaatggaaactctctccctgtgtaatctgcaaaaggatacttataagcccttctaggcctatggtgaaaaaggaaataccttcacataaaaacctgacagaagattgctgagaaacttctttgtgatgtgtgcattcatctcacagaggtaaacgtttgttgtcattgagcagattggacactctgttattgtacaatctgcaaatggatattcgtgagggctttgaggcctatggtgaaaaaggaaatatcttcacttgaaaacttgacagaagttttgtgagaaacatctttgtgatgtgtgcattcatctcatggagttgaactttttttgattgagcagtttggaaatagtcttattgtagaatctgcaatgggataatgagagctttgagggctatggtgacaaaggaaatatcttcaattaaaaactagacagaaggtttctgaggaactcctatgtaatgtgtgcattcatttcacagaggtaaatgtttcttttcattgagcacattgaaactctgttcttgtagattgtgaaaagggatatttgagagtgctttgaggtgtatggtgaaaaagcatatatgttcatataaaaacaagacagaagcattctgagaaacttctttgtgatgtgtgcattcatctcacagagttgaacattccttttgattgatcaatttggaacctgtcgttttttaggatctgcaaagggatatttgtgagtgctttgaggcctatggtgaaaaaggaaatatcttcacataaaaactagacagaaggtttctgagaaactgctttgtgatgtgtggattcatctcacagaggtaaacttttcatttttcaaaaggaaatatcttcacataaaaactagacagaaggtttatgggaaactgctttgtgatgattgcattcatctcacagagctaaacgttacttttgattgagcagattggaaattctgttcttctagaatctgcgaaggtgtatttgtgagtgctttgagacctatggtgaaaaatgaaatatcttcacataaaaacaaaacagaagctttctgggaagcttctttgtgatgtctgccttcacctcaaagagttgaaactttcttttgattgagcaatttgtaacagtcttttttagaatctgcaaagggatatttgtgagcactttgaggtctatggtaaaaaaggaaatatcttcacataaaaattagacagaaactttctgagaaagttctttatgatgtgtgcattcatctcacagagttaaatttttctttgattgagcagtttcaaaagagtcttttagtagaatctacaacgggagacttgtgagtgctttgaagcctatgttcaaaaaggaaatatcgtcacataagatctagacagaaattttctgagaaactgctttgtgatgtgtgcattcaactcacagagttgaacctttcttttgattgagcagtttgtaacattcttttttagaatctgcaaagggatatttgtgagcactttgaggtctatggtgaaaaaggaaatatcttcacataaaatctagacagaaactttctgagaaagttctttatgatacttgcattcatctcacagagttaaatttttctttgattgagcagtttcaaaagagtctttttgtagaatctgtcaagggatacttgtgagtgctttgaagcctatgttcaaaaaggaaatatcttcacataaaaactagaaagaacatttctgagaaactgctttgtgatgtgtgcattcatctcacagaagtaaaagtttcctttcattgagcggattggaaactttgttcttctagaatctgcaaagggatatttgtgagtgttttcaggcctatggtgaaaaaggaaataccttcacaaaaaaactggacagaagatttctgagaacctgctttgtgatgtgtgcattcatctcacagagttgtatttttctattcattgagcagtttggaaaccttctttttgtagaatctgcaaggggatatttttgagtgctttgaggtctatggtgaaaaaggaaatatctacatataaaaactaaagagaagatttctgagaacctgctttgtgatgggtgcagtcatctga

SEQ ID NO: 65 - DNA, 5001 bp, Homo sapiens
acataggtaaacatttcttttcattgagaagattggaatctctgttcttgtagaatcttcaaagggatattttggcgtgctttgaggcctagggtgaaaaaggaaatatcttcacatataaactagatagaaggtttctgagaaactggtttgtcaagtgtgccttcatctcacagtggtaaatgtttcttttcattgagcagatttgaaactctgctcttgtagactctgcaattggatatttttgactgctttgagacctacggtgaaaaaggaaatatcttcacataaaaactagaaagaagttctctgagaaactgctttgtgatgtgtgcattcatctcacagagataaacgtttcttttctttgaacagtttggaaactatgttcttccagcatgtgaaaagggatattcgtgaatgctttgaggcctatggtggaaaagtaaatatgttaacataacatatttgtgatctgtgcattcatctcgcacaagtaaacatttcatttcattgagcagtttagaaactctgtctttctataatctgcaaagagatacacgtgagtgctttgaggcctacggtcaaaaaagaaatatcttcacataaaaactacaaagaagatttctgagaaactgctttgtgatgtatgctttcgtctcagagagttgaacatttcttttaattgtgcagtttgccaacagtttttggtagaatctgcaaagggatatttgtgagcggtttgaggcctatgataaaaaatgaaatatcttcacataaaaactagacagaaggcttctgagaaacttttttgtaatgtttgcattcatctcacagagttgaacctttcttttgattgagcagtttggaaacagtctttgtgtagactctgcaaagggatatttgtgagcactttgaggcatattgtgaaaaaggaaatatcttcacataaaaactagacagaagctttctgagaaactgctttgtgatgtgtgcattcatctcacagaggtaaaaatttcttttcattgagtagtttggaaactttgatattgtacaatctgtaaagggatatatgtgagccctttgagtattagggtgaaaaaggaaatatcttcacataaacactagacagaagcttctgagagacttctctgtgatgtgcattcatctcaaagagttgcaccactcttttgattgagcagtttggaaacagtctttttgtagattccacaaaggtatattttggagctcattgcggcctatagtgaaaaaggaaatatcctcacatataaactagaaagaagctttctgagaaagtcctttctgatgcctgcatttatctcacagaggtaaacatttcttttcattgagcagtttgtaaactctgttcttcaagaatctgcaaagggatatttatgaacgctttgagtcctatggtcaaaaaggaaacatcttcacattaaaactagaaagaagctttctcaggaagtgctttgtgatgtgtgcattcatcttacagaggtaaacgtttattttcattgagcagcttagaaactcaactccgttctcctagaatctgcaaaggaacattttggagtgctttgaggcctatggtgaaaaaggaaatatcatcgcatagaaactagacagaagctttctgagaaactcctttgtgatgtgtgcattcatctcacagagttgagtaattcttttgattgagcagttttgaaacagtatttttggagaatctgcaaagggatattttggaacaccttgaggagtatggtgaaaaaggaaatatcttcacataaaaaatggaaagaagctttgtgagaaactgctttgtgaagtgtgcatttatctcaaagagttgaaccattcttttgattgagcagtttggaagcagtccttttgtagaatatgcaagcggataattgggagcacgttgtggcttatggtgataaaggaaatatcttcacataacaactagaaagaagttttctgagcaactgcttagtgatgtgtgcattcatctcacagaggtaaacgaatcttttcattgagctgttggaaactcttcttctggaatcagcaaagggatatatctgagtcctttgaggcctattgtggaaaagtaaatatcttcacttaagaactagacagaaactttctgagaaacttctttgtgatgtgtgcattcatctcccagagttgagccattctttaggtggaccagtttggaaacaatctttttgtagaatctgcaaagggatatttgggagcactttaagacctatggttaaaaaggaaatatctttacataaaaactagaaagaagctttctgagaaactgctttgtgatgtgtgcattcatctcacagagttgaaccattcttttgactgagcaggttggaaacagtctttttttagaatctgcaaaggcatatttgttagtgctttgaggcctatggtgaaaaaggaaatatcatcacatagaaactagacagaagctttctgagaaacttgtttgtgatgtgtgcagtcatctcaaagagttgaaccatcactttgattgagcagtttggaaactgtctttctgtggaatctgcaaagggatattcgggagtgcattgaggcctaaggtgaaaaaggaaatatcttcacaaaaaaactaaaaggaatctttctgagaaactgtgcatttatctcacataggtaaattttctcttcattgagcagtttggaaactctgttcttctagaatctccaaagggatatttgtgagtgctttgatgcctacggcaaaaagggaaatatattcacacaaaaactacacaaaagcttttggagaaacttttttttttttttttttgagatggagacttactctattctccagactggattgcagtggcacaatctcggctcactgcaagctctgcctcccaggttcatgccattctccttcctcagcctcccgagtagctgggactacagacacccaccaccatgcctagctaattttttgtgtttttactagagatggggtttaactgtgttagcgaggatggtcttgatcacctgacctcatgatccatccgccatggcctcccaaagtgcttggtttacagacatgagccactgcacctggccaaaaacttctttttaatgtgtgcattcatctcacagagttcaaacattctttagatcgagcactttctgcaaacggagattagggagtgctttgaggcctatggtggaataagaaatatcttcacataaaaactggacagaagcattctgaaaatcttctctgtgatgtgtgcattcatctcagagagttgaaccatagttttgattgagcagtttggaaaaagtctttttgtagattccacaaagggatattttggagcttgttgaggcctatggtgaaaaatgaaatatcctcacataaaaactagaaagaagctttctgagaaagtgcgttctgatgcgtgcattcatctcacagaggtaaacgtttcttttcattgagcagtttgtaaactctgttcttcaagaatctgcaaagggatatttgtgagcacattgaggcctacgctaaaaaaggaaatatcttcaaataaaaactagaaagaatctttctgagaaactactttgtgatgtgtgcattcatctcagagaagtaaaagtttcttttcagagaagtaaaagtttcttttcattgagcagtttggaaagtctgttcttctagaacttgcaaaaggatattttggagtgctttgaggcctatagtgaaaaaggaaatatcatcacatagaaactagacaaaagctttctgagaaactcctttgtgatgtgtggactcatctcacagagttgaaccattcttttgattgagcagtttggaaacagtctttttgtagaatctgaaaagggatatttgtgagtgctttgaggactacagtgaaaaaggaaatatcttcacatgaaaaggagaaagaagctttatgagaaactactgtgtgatgtgtacattcatctcaccaaggtaaacgtttcttttcattgagcagtttggaaactctgttcttctaggatctccaaagggatatttttgagcacttttaggccggtggcaaaaaaagaaatatcttcacataaaaactagacagaagctttctgagaaacttctttgggatgtgtgcattcatctcacagaattgaaccattctttagattgaccagtttggaaacaatctttttgtagaatctgtgaagggatatttgggagtgctttgaggtttatggtggaaaaggaaatatcttcacatgaaaactagaaagaagaatcagagaaccttctttgtgatttgggctttcatctcactgaattgaaacatatttttgacaggggagttttgaaacaggctgtttgtagtatctgcaaagggatatatgggagcatgttgaatccaatggtgaaacaggaaatatattcacataaaaattacacagaagctttctgtggaacttctttgtgatgagtcctttcatctcacagagttgaaaccattccgtgattgagtattttggaaacagtctttttgtacaatctgcaaggagatattgggagctctttcagacctaagctgaaaaaggtaatatcttcacaaaaaaactagaaagaaactttctgagaaactgctgtgtgatgcatgcattcatctcatagatgtaatggtttcttttaattgagcagtttggaaactgttgtcctagagtctgaaaatggatttttgggagcatgttggggcctgttgtgaaaagttaatatcttcacataaaaaccagacagaagctttctgggaaacttctttctgatgtgtgcattcatctcacagagttgaaccattattttgatatagcagtttggaaacagtctttttgttgaatctgcaaaggcatattcaagagtgcactggggcctatggtgaa

SEQ ID NO: 66 - DNA, 5001 bp, Homo sapiens
aaaaggaaatatattcacataataactagaaagacgctttcagagaaacttctttttgatgactgcattcatctcagaggtaaacttttcttatcagttagcagtttggaaactctgttcctctagactctgaaaaaggatatttgtgagcactttgagacctatggtgaaaaaaaggaatactttacataaaaactagacagaagcttcctgaaaaactttttttgtgaggtgtgaattcttctcacagagctgaatcattctttctattgagcagtttggaaagagtctttttgtagaatctgtaaaggtatatttgggagtgggttaaggcctacagtgaaaaaggaaatatcttcacataaaaactagaaagaagctttctgataaactgttttctgaggagtgcattcatctaacacaggtcaacttttcatttagccatttggaaactctgttcttctaaaatctacaaagggatatctgttagctctttgagacctaaggttcaataagaaatatcttcacataagaactagacagaagctttctgataaacttctttgtgatgcgtgcattcatctcacagatttgaaccattgtattgattgactagtatggaaacagtctttttgaagaatctgcacatggatatttgggagtgtgttgaggcgtatagttaaaaaggaaatatcttctcattaaaactagagggaagctttctgagaaactactttgtgatgtgtgcattcatctgaaaaagttgaacgtttcttttcatttattagtttggaatctgtgttcttctagagtctgcaaagagatatttgtgagtgctttgatggctatggtgaaaaggaagtatcgtgatgtaaaaactagacagaagctttctgagaaacttatttgtgatgagtgcattcatctcacagaggtgaaccattttctgattgaacagtttggaaacagtcttttttagaaatggcaaaattatactggtgagtgctttgaggcctatggtgaaaaagcaaatatcttcacataaaaactggaaagaagctttctcagaaactgctttgtgacctgtgcattcatctgacagaggtaaacgtttcttttcaatgagcagtttggaaaaatctgttgttctagcatcttcaaagggatgtttgtgagtgctttgattcctatggtgatttaggaaatatcttcacataaaaactagacagaagctgtctgagaatcttcaatgtgatgtgtgcatttatttggcagagttgaaccattctttcatttgagcagtttggaaacagactttttgtagaatctacaaaggaatatttgggagcactttgaggcctatggtgaaaaaggaagtatcctctcttaaaaattagaaagaagctttctgagaaactagtttgtgatatggacattcatctcacagaggtaaagttttatttttattgagcagcttggaaactctgtttttctagaatctgcaaagggatatttatgagcactttcaggcctatggtgaaaaagtaaatgtcttcacataaaagtagaaagaaacttactgaaaacttctttgtgatgtgtgcattcatctcacagggttgaaccattcttttgattgagcattttggaaaccctattttgtagaatctgcaaagggataattgtgagcactttgagcctatggtgaaaaaggaaatatcttcacataaaaagtagaaagaagtgttctgagaaacttatttgtgatctgtgcattcatctcgcttaagtaaacgtttattttcttggaacagtttggaaatttttttcttctagaagctgcagaggggtagttttgagcactttgaggcctaaggtgaaaagtaaatatcttcacatgaaaactaggcagaaactttctgagaaacttcttcatgacatgtgcattcatctcatagagttgaaccattcttttgactgagcagtttggaaatcgtctttttgtaagatctacaaagggatatttggaagcccttagaggcttatgatgaaaaaggaaatgtcttcacataaaaactacacacaatctttctgagaaaatgctttgtaatgtttgcattcatctcatagatgtaaacgtttcttttcattaagctgtttggaatctttgttcctctgggatctgcaaagcaatatttgtcagcactttgaatccaagtgtgaaaaaggaaatatcttcacataaaaactagacagaaagtttctgaggaacttatttgtgatgtgtgcattcctctgacagtgccgaacagttcttttgtttgagaagtttggaaacagtctttttgtagaatctacaaaggtatattttggagcactttgaggcctatggtgagaaaggaaatatcttcatatgaaacctagaaagaagctttctgagaaactgttttgtgatgtgtgcattcatctcacagagttaaacatttcttttgattgagcagtttggaaactctgttctttttttttttttttttaatttatttttttattgataattcttggctgtttctcacagagggggatttggcagggtcatgggacaatagtggagggaaggtcagcagataaacaagtgaacaaaggtctctggttttcctaggcagaggaccctgcggccttccgcagtgtttgtgtccctgattacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggatcccaaggcagaggaatttttcttagtgcagaacaaaatgaaaagtctcccatgtctacttctttctacacagacacggcaaccatccgatttctcaatcttttccccacctttcccgcctttctattccacaaagccgccattgtcatcctggcccgttctcaatgagctgttgggcacacctcccagacggggtggtggccaggcagaggggctcctcacctcccagtaggggtggcctggcagaggcgcccctcacctcccggacggggcggctggccgggcggggggctgaacccccacctccctcccggacggggcggctggtcgggcagaggggctcctcacttcccagtaggggcggccgggcagaggcgcccctcacctcccggacggggcggctggccgggcgggggggctgaccccccccacctccctcccggacggggcggctggccgggcggggggctgaacccccacctccctcccggacggggcgactggccgggcggggggctgacacccccaactccctcccggaccgggcggctggccgggctgaggggctcctcacttcccagtaggggcggccgggcagaggcgcccctcacctcccagacggggcggctggccgggcggagggctgacccccccacctccctcccggacggggcggctggccaggcggtggggctgaccccccatctccctcccggacggggtggctggccgggtgggggggctgacccccccatctccctcccggacggggcggctggccgggccaatgggctcctcacttcccagtaggggcggccgggcagaggcgcccctcacctcccggacggggcggctggccgggcggggggctgacccccccacctccctcccggacggcacggctggccgggcgggggggctgaccgcccacctccctcccggatggggcggctggccgggcggggggctgaccccccccacctccctcccggacagggtggctgccgggcggagacgctcctcacttcccagatggggtggctgctgggcggagaggctcctcacttctcagatggggcagctgccgggcggaggggctcctcacttctcagacggggtggttgccaggcagagggtctcctcacttctcagacggggcggccgggcagagacgctcctcacctcccagacggggtctcggccgggctgaggcgctcctcacatcccagatggggcggcggggcagaggcgctccccacatctcagacgatgggcggccgggcagagacgctcctcacttcctagatgtgatggcggctgggaagaggcgctcctcacttcctagatgggatggcggccgggcggagacgctcctcactttccagactgggcagccaggcagaggggctcctcacatcccagatgatgggcggccaggcagagacactcctcacttcccagacggggtggcggccgggcagaggctgcaatctcggcactttgggaggccaaggcaggcggctgggaggtgtaggttgtagtgagccaagatcacgccactgcactccagcctgggcaccattgagcactgagtgaacgagactccgtctgcaatcctggcacctcgggaggccgaggttggcggatcactcgcggttaggggctggagaccggcccggccaacacagcgaaaccccgtctccaccaaaaccagtcaggcgtcgcggcgcatgcctgcaatcgcaggcattcggcagactgaggcaggagaatcaggcagggaggttgcagtgagccgagatggcagcagtacagtccagcttcggctccgcatgagagggagaccgtggagacggagagggagagggagagggagagggagagggagagggagagggagacggaaactctgttcttgtagaatctgcaaagggatattttggagaactttgaggcctatggttaaaaaggaaatatcttcgcataaaaactatacagaagcactctgagaaacttctttttggtgtgtgcattcgtctcacagagttgaaccatctttttgattgagcagtttggaaacagtctttttgtagaatacacaaacagatatttatgagtgctttgaagtctatggtggaaaaggaaatatc

SEQ ID NO: 67 - DNA, 5001 bp, Homo sapiens
cttcacataaaaactagaaggatgctttctgagagaatgctttgtaatgtgtgcattcatctcacagagtttgaccattcttttgatggagccgtttggaaccacttttttttagaatctgcaaagggatatttgggagccctttgagtcttatggtgggaaaggaaatacgctcacatgaaaattagaaaggagatttctgagaaacttctttgtgatatgtgtattcatctcacagagttaaaactttcttttgatggaatattttggaaacaccgtttttgtagaatctgcaaatggatatttccaagcgctttcaggcccgtggtgaaaaaggaagtatcttcaactaaaaactcgactgaaactttctgagaaactgcttcatgatgtgtgcattcctctcacagaattgaaccattcttttgactgagcagtttggaaccactgttttcctagaatctgcaaagggatatttgtaagcactttgaggtctctggtgaaaaaggaaatatcctcacataaaaactagaaaggagctttcttagaaacttctttgttatctatgcatttatctcacagaattcaaccattcttttgattgagcagtttggaaacacagtgtttgaaggatctgcaaagggatatttgtattcaccttgaggcctataaggaaaaaggaaataccttctgatacaaactagacagaaactttctgagagatgactttgtgatgtgtgcattcgtcacacggagttaaacatttctttttattgagcattttgtaaactcttctagaatctgcaaagggctatttgttagtgcattgaggcctatggtgaaaaaggaaatatcttccgatacaaactagaaacagattttctgagaaactgctttgtggtgtgtgcatttacatcacaaagttgaacaattcttttgatttgagcagtttggaaacagagtgtttgtagaatatgcaaagggatatttggatttgcatggagacctgtgtttaaaaaggaaatatcttccaatacaagctagactgaagctttctaagagaatgttttgtaatgtgtacattcatcccacagagttaaacttttttttttcattgagcagtttggaaactctgatcttccagaatctccaaagggatatttgggagcatattaaggcctatggtgaaaaaggaaatgtcttccaatacaaactagaaagagagtttctgaggaactgctttgtgatgtgtgcattcatctcaaggagttgaaccattgttttggttaagcagtttggaaatacagtgtttgtagaatatgtgaagggatatttggattcccatggaggcctgtagtgaaaaaggaaatatcttctgatacaagctaatcagaagctttctaagagaatgctttgtaaaatgtgcattcatccaacagagttaaatgtttcttttcattgagcagtttgtaaactctgttattccagaatctccaaagggatatttgggagcgcattgaggcctatggtgaaaaaggaaatatcttctgatacaaactagaaagagagtttctgaggaactgctttgtatgtgtgcattcatctcaaggagttgaaccattcttttggttgagcagtttggaaacacagtgtttgtagaatctttgaagggatattttgattcgcatggaggccagtggtgaaaaaggaaatatcttctgaaacaaactagacacaagatttctgagagactgctttgtgatgtgtgcattcatctcacagagttgaaccattctttgatggagcagtctgtttttgtagaatctgcaaagctatattttagagccctttgagtcttatggtgagaaaggaaatatactcacataaaaacttgaaaggaccttgctgataaacttctttatgatatgtgccttcatctcaaagatttaaaactttcttttgatggagcaatttcgaaacaccttttttgtagtatcagcaaagggatattactgggcactttctggcctatgttgaaaaaggaaatatctacacctaaaaagttgaaagaagttttctgagaaactgctctgtaatgtgtgcaatcctctcaaagggttgaaccattcttttgattgagcagtttataccctctgtttttctagaatctgcaaatggatatttgtgttttgaggtctatggtgaaaaaggaaatctcctcacataaaaactagaaaggagctttcttagaaactgctttgtgatctgtgagtttatctcacagagttaaatgattctttaaattgagcattttggaaacacagtgtttgaagaatctgcaaagggatatttggattcaccttgaggcctaagaggaaaaaggaaatatcatctgatacaaaacagaagctttctgagagactgctttgctatttatcccacagagttaaatgcttcttttcattgagcagtttggaaactctgttcttctagaatctgcaaagggatatttgggagcacattgaggcctaaagtgaaaaagaaaatgtcttcacataaaagctaaaaagaagctttctgagaatctgctttgagatgtgtgcgttcatctcacagaggtaaaagtttcttttcactaagcagtgtggaaacacagtgttggtagaatctgtgaaggcatatttggattcacatggaggcctgtggtgataaagggaatatattctgatacaaactagacattaactttctgagagactgctttgtgacgtgtgcattcatctcacagagttgaaccattctttgatgtagcagtttggaaccagtttttgtagaatctgcaaacggatgttgggagccctttgagtctcatggtgaaaaaggaaataccctgacataaaaactagaaaagagatttctgagaaactgctttgtgatatgtgcatttatctcccagagttaaaactttcttttgatggagcatcttgaaaacaccgtttttgtagtatctgcctagggatatttcagagtgctttcaggcctatgctgaaaaaggaaatatcttcacctaaaaactcaaagaaagcattctgagacactgctttgtgatgtgggcattgttctcacagagttgagccattcttttgattgagcagtttggaaacacagcgttttaagaatccgcaatgggatatttggattcacatgaagacctgttttgtaaaagtaaatatcttccaatataaactacatggaagctttctgagagaatgctttgtaatgtgtgcattcatccagagagttcaaagtttctttcattagcagtgtggaagcacttcttcttctagaatctgcaaaaggatatttgggagcccattgaggcctatggtgaaaaaggaaatatcttattatgcaaactagaaagagagtttctgagaaactgctttgtggtgtgtgcattcatctcacagagttgaactattcgtttgatgtagcattttggaaccactgtttttgtagattctgcaaagggataattgggagcccattgagtcttatggtgaaaaaggaaatatcctcctataaaaactagaaagcagctttctgagaaactgctttgtgatatatgcattcatctcacagaattaaaactttctgttgatggagcattttggaaacaccgtttttgcagaatctgcaaagggatttttcagagcgctttctggcctctggtgaaaaaggaaatatcttcacctaaaaactcgaaggaagctttctgagaaactgcttcatgatgcgtgcattcctctcacaaagttgaaccattcttttgacttagcagtgtagaaccattgtttttctagaatctgcagagggttatttgtgagcgctttgaggtctatggtgaaaaaggataaatcctcacattaaaactggaaaggagctttcttagagactactttgtgttctgtgtgttcatctcacagagttaaaccattctgttgattgatcagtttggaaacacagtgtttgaagtatctgcgaagggatatttggattcaccttgatgactatgcagaaaaagtaaatatcttctgatacaaactagactgaaacagtctgagagactgctttgtgatgtgtgcattcatatcacagagttaaacttttcttttcattgagcagtttggaaactctgttcttccaaaaactgcaaagggacatttgggagcaatttaaggtttatggtgtaaaaggaaatatactcacataaaaactagaacggagctttcttagaaattgctttgtgatctgtgtgttcatctcacagacttaaaccattcttttgattgagcagtttggaaacacagtgtttgtagaatctgcgaagggatatttcatttcccatggaggcttgtagtcagaaaggaaatactttctgatacaaactagacagaatccttcagaaagaatgctttgtaatgtgtgcattcatctcacagagttaaacatttcttttaattgagcagtttggaaactcagttcttctagaatcttcaaagggatatttgggagtgcactgaagcctctggcaaaaaaggaaatatcatctgatagaaactaggaagagagtttctgagaaactgctttttgatatatgcattcatttcacagagttgaacaattcttttgactgagcagcttggaaacacagtgattgtagaacctgcaaagggatatttggattcacatggaggcctgtggtgaaaaaggaaatgtcttctgatacaaactagagagaagctttctgagagactactttgtgatgtgtgcattcatatcacagtgttgaaccattcttttgatggagcagtttggaaccactgtttttgtagactcttcaaagtgatatttgggagccctttgagtcttatggtaaaaaaggaaatatcctcacataaaaagaagaaagaagcttcctgagaaaatgctttgtgatgt

SEQ ID NO: 68 - DNA, 5001 bp, Homo sapiens
tgtgcattcatctcacagagttaaaactttcttttaatggaacactttggaaaccccatttttgtagaatctgcaaagggatatttcagatcgcttccaagcctatggaggaaaaggaaatatcttcacttaaaaaaatcataggaagcgttctgagaaactgcttcaagatatgtgcattcctctcatagagttgaaccattcttttggttgagaagtttggaaacactgtttttctagaatctgcaaatagatttttgtgagtgctttgagatctatggtgaaaaaggaaatatcctcacataaaaactagaaaggagctttcctagaaactgctttgtgatctgtgcattcatatcacagagttgaagcataattttgattgagcagtttggaaacacagtgtttgtagaatctgtgaagggatatttggattcaccttgtgtcctatggggaaaaaggaaatatcttctgatacatactacagagaagctttctgagagactgctttgcaatgtgtgcattcatctcaaagagttaaaagtttcttttcattgagcagtttggaaactctgttcttctagaacctgtaaagggatatttgggggagcattgaggcctatggtgaaaaagaaaatattttctgatacacactagaaagacagtttctgagaaactgctttgagatgtgtgcattcatctcacagagttgaatgataattttgatagagcagtttggaaacacagtgtttatagaatctgtgaaagggtatttggattcgctttgagggctatggggaaaaaggaaatatcttctgatacaaactatagagaagatttctgacagactgctttgtgatgtgtgcattcatttaacagagttaaacatttcttttctttgagcagtttagaaactcttttcttttagaatctgcaaagggatatttgggaatgcattggggcctatggtgaaaaaagaaatatcttccgatataaactagaaagagagtttctgagaaactgctttgtaatctgtgtgcttttatctcacagaaatgaaccattattttgattgagcaatttggaaacacattatttgtaaaatctgcaaagggatatttggattcacatagaggcctgcagttgaaaaggaaataacttccaacacaaactagacagaagctttctgagagactactttgtgatgtgtgcattcatctcacagatttgaaccattcttttgagggagcagttttgaaccactacttttgtagaatctgcaaagggatatttgggagccctttgagtcttaggttggaaaaggaaatatcctcacataaaaacaagcaaggatctttctgaaaaactgcttcatgatatgtgcattcatctcacagagttgaaactttcctttcatggagcattttgtaaacaccgtttttgtagaatctgcaaagcgatattttggaaagtttcaggcgtatggtcaaaaaggaaatgtcttcacctaaaaactcgaagaatgctttttgagaaactgctttatcatgtgtgcattcctctcacggagttgaacctttcctttaattgagcagtttagaaccactgtttttctagaatctgcaaatggatatttgtgagcgttttgaggtctatggtgaaaaaggaaatatcctcacataaaaagtaggaaggagctttcttagaaactgctttgtgatctgtgcattcatctcagagttaaaccattcttttgatagagcagtttggaaaagagtgtttgaagtatctgtgaggggatatttcaatttgccttgaggcctgtggggcaaaaggaaatatcttctgctacaaactggacagaagctttctgagaaatggctgtgcaatgtgtgcattcacctcacagatttaaacgtttcttttcattgagcagttcagaaactctcttcttctggaaactgcagagggatatttggaagtgcattgaggcttatgttgaaaaaggaaatatcttctgatacatactggaaagagagtttctgagaaactgctttgggatgtgtgcattcatctcacagagttgtactattttttttatggagcagtttggagccactgttttccttttttttttttttgttttgccctgattatatttattattattattattattattattattattatactttaagttttagggtacatgtgcacaatatacaggttagttacatatgtatacatgtgtcatgctggtgcgctgcacccactaactcatcctctagcattaggtatatctcccaatgctatccctcccccctccccctaacccacaacagtccccagaatgtgatgttccctttcctctgtccatgtgttctcattgttcaattcccacctatgagtgagaatatgtggtgtttggttttttgttcttgcgatagtttactgagaatgatgatttccgatttcacccatgtccctacaaaggacatgaactcaccattttttatggctgcatagtattccatggtgtatatgtgccacattttcttaatccagtctatcattgttggacatttggattggttccaagtctttgctattgtgaataatgccgcaataaacatacgtgtgcatgtgtctttatagcagcatgatttatagtcctttgggtatatacccagtaatgggatggctgggtcaaatggtatttctagttctagatcccggaggaatcaccacactgacttccacagtggtttaactagtttacagtcccaccaacagtgtaaaagtgttcctatttctccacatcctctccagcacctgttgtttcctgactttttagtgattgccattctaactggtatgagatggtatctcattgtggttttgacttgcatttctctgatggccagtgatgatgagcattttttcatgtgttttttggctgcataaatgtcttattttgagaagtgtctgttcatgtctttcgcccactttttgatggggttgtttgttttttttcttgtaaatttgtttgagttcattgtagattctggatattagccctttgtcagatgagtaggttgcgaaaattttctcccattttgtaggttgcctgatcactctgatggtagtttattttgctgtgcagaagctctttagtttaattagatcccatttgtcaactttggcttttgttgccattgcttttggtgttttagacatgaagtccttgtccatgtctatgtcctgaatggtaatgcctaggttttcttctagggtttttatggttttaggtcgaaggtttaagtctttaatccatcttgaattaatttttgtataaggtgtaaggaagggatccagtttcaactttctacatatggctagccagctttcccagcatcatttattaaatagggaatcctttctccattgctttttttctcaggtttttcaaagatcagatagttgtagatatgtggtgttatttctgagggttctgctctgttccattggtctatatctctgttttggtaccagtagcatgctgttttggttactgtagccttgtagtgtagttggaagtcaggtagtgtgatgcctccagcttagttcttttggcttaggattgacttggcgatgcatgctctatcatactgaatgggcaaaagctggaagcattccctttgaaaactggcacaagacagggatgccctctctcaccactccttttcaacatagtgttggaagttctggccagggcaattagacaggagaaggaaataaaatttattcatttaggaaaagaggaagtcaaattgtccctgtttgcagacgacatgattgtatatctagaaaaccccattgtctcagcccaaaatctccttaagctgataagcaacttcagcaaattctcaggatacaaaatcaatgtacaaaaatcacaagcattcttatacaccaacaacagagaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagatcattccatgctcatgggtaggaagaatcagtatcatgaaaatggccatactgcccaaggtaatttacagattcaatgtcatccccatgaagctaccagtgactttcttcacagaattggaaaaaactactttaaagttcatatggagccactgcttttctagaatctgcaaagggatatttgggagtgctttgagtccaatggtgaaaaaggaaatgtcttccaatacaaactagaaagggagtttctgagaaactgatttgtgatgtgtgcattcatctcacagagttgaaccattcttttgatggagcagtttggaaacacagtgtttgtagaatctgtgaaaggatatttggatttgcatgtaggccagtggtgaaaaaggaaatatcttccaatacaaactagacagaagttttctgagagaatgctttgtaatgtgtgcattcatcctacaggttaaacgtttcttttcattgaccagtttggaatctctgatcttctagaatctgcaaagggatatttgggagcacattgaggtctacggtgagaaaggaaatatcttctgatacaaaccagaaagagagattctcagaaactgctttgagatgtgtgcattcatctcacatagttgaaccacacttttgatggagcagtttagagccactctttttgtagaatctgaaaatggatatttgggagccctttgagtcttatggtgaaaaagaaatatccttacataaaaactagaaaggagatctctcataaactgctttgtgatatttgcatttatctcacagaattaaaaccttcttttgatggagcattttggaaacaccatttttgtagaatctg

SEQ ID NO: 69 - DNA, 5001 bp, Homo sapiens
gcaaagggatattttggagaactttcatgcctatagtgataaaggaaatatcttcacctaaaaactcgaaggaagctttctgagaaactgctgtgtggtatgggcattcctctcacagagttgaaccattcttttgattgagcagtttggaaccactgtttttctagaatctgccaagggatatgtatgagtgctttgaggtctgcagtaaaaaagtccatatcctcatataaaaactagaaaggagctttcttagaaacagctttgtgatctttgcattcatctcactgagttaaaccattcttttgtttgaatagtttggaaacacagtgtttgaagaatctgctaagggatatttggattcgccttgaggcctatggagaaaaaggaaatatcttctgatactaactagacagaagctttctgagagactgctttgagatgagtgcattcacctcacagagtttaacatttcttttcacttgagcagtttggaaactctgttcttctagaatctgcaaagggatatttgggagcatgttgaggcctatggtgaaaaagggaaatatcctctgatacaaactagaaagagagtttctgagaaactgctttgtgacgtgtgcattcacctcacagggttgaaacatttctttattgagcagtttggaaataagagtttttgtggaatctctcaagggatattcagatttgcatggaggccagtggtgtaaaaggaattatcttccaataaaaactagacagaggctttctgagagaatgctttgtgatgtgtgcattcatctcacagagttgaaccattcttttgatggagtcgtttggaaccactgtttttgtacaatctgaaaagggatatttgggagcagtttgagtcttttggtgaaaaataaaatatctccacataaaaactagaaaggacatttatgagaaactgctttgtgatatgtatattcatctcacagagttaaaagtttcttttaatggagcattttggaaacaccgttttagtagaatctgcaaagggatattttggagccctttcctggctatggtgaaaaaggaaatatcgtcacctaaaaactcgaaggaagctttctgagaaactgctttgtgatgtgtgcattcccctcacagaatcaaaccattcttttgattgagcagtttggaaccactgtttttctagaatctgcaaagggatatttgtgagtgctttgaaatctatggtgaaaacggaaatatcttgtgatacaaactagaaagagagtttctgagaaactgctctgtgatgtgtgcattcatcttacagagttgaacctttattttgattgagcagtttggaaacagtctttttctagaatctgcaaggggatatttgggagcgcattgaggcccatggtgaaaaagttaatatcttctgatacaaactcgaaacaaagattctgagaaattgctttgtgatgtgtgcattcatctcacagagtttaaccattttttaattgagcatttaggaaacacagtatctgtaaaatctgtgaaggtatatttagattccccttaagtcctatggtgacaaaggaaataccttctgattcaaactagaaagaagctttctgaggatccactttgtgatgtgggcattcctctaacagagttgaaccattattttgattaagcagtttggaaccactgttttcctagaatcttcaaagggatatttttgagttctttgaggcctatggtgaaaaaggaaatattctcacataaaaactagaaacaagctttcttgggaactgctttgtttagtgtgtattcgtctcacagcattagacctttcttttcattgagcagcttggaaactgttcttctagaatctgcaaagggatatttgggagctcattgaggcctatgatgaaaaaggaaatacattctgatacaaagtagaaagaaagtttctgagaaattgctttgtgatgtgtgcattggtctcacagagtttaacaaatcttttgatttagcagtttggaaactgtttgtagactgcaatgggatatttggattcgcatgaagccttttttaacaaaggaaacatcttctgatacaaactagacagaagctttctgaggaactgctttgtgatgtgtgcattcctctcacagagatgaagcttgctttttattgagcaatttggaatcactgttcttgtagaatctgcaaagtgatatttgggagcattttgaggcctatgttgaaaaaggaaatatcttcacataaaaactagaaagaacctttctgagaaaatgctttgcgatgtgtgcattcctctaacagacttgaactgttctttggagtgaatagtttggaaccactggctttctacagtctgaaaaggaatatttgtgagcattttgaagcctatgctgaaaaaggaaatatcctcacataaacactagaaaggagctttcttagaaactgctttgtggtgtgtgcattcgtttcacagagttcaacatttctcttcattgagcaacttggaaactctattcttcttgaatctgcaaagggatatttgcagtgtcttgaggcctatggcaaaaaaggaaataccttctgatacaaactagaaagaaagtttctgagaaattgctttctgatacgtgcattcttatcacagagcttaaccccctttttgattgagctgtttggaaacacagtgcttgtagaaactgcgaacaggtgtttagattcgccttgaggcctatggtgacaaaggaaatatcttctgacacaaactagacagaggctttctgaggaacttctttgtgatgtgtgcaatcctttcacagagttgaactgtttttttgattgagcagtttggaaacactgttgttctagaatctgcaaagggatatttgtgagcactttgaggcctatgctaaaaaaggatatgtcctcacataaaaaccagaaagaagctttcttagaaactgctttgtgattgtgcattcatctcacagagttaaacatttcttttcattgagcagtttggaatctctgttcttgtagaattttcaaagggatatttttgagggctttgaggtcaatggtcaaaaaggaaatatactcacataaaaactagaaaggagctttcttaaaaactgctttgtgatgtgtgcattcatctcatggagttaaacttttctttatgttgagcagtttggaaactttgttcttctagaatctgcaaagggatatttggagtgcattgaggcctatggtgaaaaaggaaatatcttctgatacaaattagaaagaaagttgctgagaaattgctttgtgatgtgggcattcatctcacagaatttagccattcttttgattgagctccttggaaacacattgtttgtagaatctgtgaagggatatttggattccccttgaggccaatggtgacaaaggaaatatcttctgatacaaactagacagaaggtttctgaggaactgctttgtgatatgtacattcctgtaacagagttgaaccattcttttggttgagcagtttggaaccactgtttttctagagtctgcaaagggatatttttgagcgtttgaggcctatggtgaaaaaggaaatatcctcacataaaaactaaaaagaagctttcttggaaactgctttgttatgtgtgcattcatctcactgcgttaaaccttttttttcattgagcagtttggaaactctgtacttctagaatctgcaaatggatatttgggattgcattgaggcctatggtgaaaaaggaaatacattctgatagaaactagaaagaaagtttctgagaaattgctttgtgttgtgtgcattcatctcagagagtttaaccattcttttcattcagcagtttggaaacagtgtttgtagaatctgcgaagggatatttggattcaccttgaggcctttttgacaaaagaaatatcttctgatacaaactagacagaagctttctgaggaactgctttgtgacgtgtgccttcctctcacagaggtgaacatttattttgatggagcattttaaaatcactcttcttgtagaatctgcaaaaggatatttgggagcgttttgaggcctatgttgaaaacagaaatatcttcacataaaaactagaaagaacttttctgagaaaattctctgtgatgtgtgcattcctgtaacagagttgaaccattcttttgattaaactgtttggaatcactctttttccagaatccacaaagggatatttgtgagaggtttgagacttacgctgaaaaaggaaatatcctcacataaaaactagaaaggaagcttcttagaaactgctttgtgatgtatgccttcatctcacagaggtaaacctttcttttcattgagcagtttggaaactctgttattctagattctacaaaaggatatttggagcaccttgaggcctatggcgaaaaaggaaacatcttccaatataaactagaaagaaagtttctgagaaattgctttctgatgtgtgcactcatctcacagagtttaaccacccttttgattgagcagtttggaaacacagtgtttgtacaacatgcaaagggatatttcgattccccttgaggcctatggtgacaaaagaaatattttctgttacaaactagacagaaggtttctgaggatcctctttgtgatgggtgcattcctctcacagagttgaaccattctattgtatgagcagtttggaaccattgtttttctagaattttctgagggatatttgtgagcgctttgaggcctatggggaaaaggaaatattctcacataaaaactagaaagaagctttcttggaaactgctttgtgatgtgtgcattcatctcaaagcattaaacctttcttttcattgagcagtttataaactctgttcttctagaatcagcaaagcgatatttgggagcacattgaggc

SEQ ID NO: 70 - DNA, 5001 bp, Homo sapiens
cctatgctgaaaaaggaaatacattccaatacaaacaagaaagaaagtttctgagaaattgctttgtgatgtgtgcattcatctcacagagtttaaccattcttttgatttagcagtttggaaacagtggttgtggaatcagcgaaggtatatttggattctccttgaggtcttttttgacgaaggaaatatcttctgatataaactagacagaagctttctgaagaactgctttgtgatgtgtgctttcctctcccagcggtgaacctttattttgattgagcagtttggaatcactgttcttgtagaatctgcaaaggtatatttgggagtgttttgaggcctgtgttgaaaaaggaaatatcttcacataaaaactagaaagaacttttctgagaaattgctttctgatgtgtacattcttctaacagagttgaaacgttattttgattgagcagttttgaactactgtttttctagaatctgccaagggatatttgtgggcgctttgaggcatatggtgaaaaaggaaatatcctcacataaatactgaaaagagctttcttagaaactgctttgtgatgtttcaattcaactcacagagttaaacgtttcttttcattgagcagtttggaaactgttctactagaatctgcaatgggatatttgggagaccattgaggcctgtggtgaaaaaggaaatatcttccaatacaaactagaaagaagttttctgagaaattgctttgctttgtgtgcattcatctcacagaatttaaccattcttttgattgagcagtttggaaacactgtgtttttttgaatatgagaagggatatttggattcgccttgaggtctgttttgaaaaaggaaatatcttctgatacaaactagacagaagcattgtgaggaactgttttgttatgtgtgaattcttctcaaggagttgaaactttcttttgattgagcagtttggaaccactgttcttgtggaatcttcaaaggcatattttggaaaacttagaggcctatggtgaaaaactaaatatcttcacataaaaactagaaagaacctttctgagaaattgcttggggatctgtgcattcctctaacagactcgaaccattctgttgattgagcagcttggaaccactgtttttctagaatctgaaagggatatttgtgagcgctttgaggcctatggtgaaaaaggaaatattctcccatataaattagaaaggagctctcttagaaactgctttgtgatgtgtgcattcgtctcacagaattaaacgtttctttttcattgagcaatttggaaactctcttcttctagaatctacaatgggatatgtgtgagtgcattgaagcctatggtggaaaaggaaatgtttttcatcacaaactagaaagaaagtttctgagaaattgctttgtgatgtgtgcatttatctcacagaatttaaccatttttttgattgagaagtttggaaaaacagtgtttgtagaatctgtgaagggatatttggattcaccttgaggcctatagtgaaaaatgaaatatcttctgatacaaattagacagaagttttctgaggaaccactctttttgtagaatctgcgaagggatatttgggagtgatttgaggtctgtggtaaaaaggaaataacctcacataaaaactgaaaggggcttcctttgaaactgctttgtgatgtgtccattcatctcactgagataaacatttcttttcattgtgcagtttggaaactctgtccttctggaatttgcaaagggatatttggaatgctttgaggcctatggtgaaaaaggaaatatcttccgataccaactagaaagaaagtatttgagaaattgttttgtggtgtgtgcattcatctgagagagttggaccattcttttcattaaggagtttggaaacacattgtttgtagaatctgtgaagggatatttggattcaccttgatgcctatggtgacaaaggaaatatcttctgatacaaactagacagaagctttctgaggaactgctttgtgatgtgtgcattgctctcacagagttgaactgttatttcgattgagcagtttagaaccactgtttttgtagaatctgcaatgggatatttgggagcactttgaggcctatgttgaaaaaggaaataatttcacataaaaactagaaagaaactttctgagaaattgctttctgatgtgtgcattcctccaacagagttgaacatatgttgaatgggcagtttggaagcactgtttttctagaatctgcaaagcgatatgtgtgagggctttgaggcctatgctgacaaagcaaatatacacacataaaaaccagaaaggagctttcttagaaactgctttgcgatgtgggcattcgtctcacagagataaatattccttttcattaggcagtttggaaactgtgttttccttgaatctgcaaagggatatttgggagtggattgaggcctacagtgaaaaaggaaatatctcctgatacaaactggaaagaaagtttttgagaaattgctttgtgatgtgtgcatccatctcacagagttgaacatttcattgaccagtttgggcacactgtttttccagaatctaaaaggggactttgtgagtgctttgagccctatggtgaaagtttcttttgattgagcagtttggaaacagtctttttgtagaatctgcaaacggatatttggagcactttgaggactatggtgaaaaatgaaatatcttcacagaaaaactagaatgaacctttcagagaaattgctttttgatgtgtgcattcctctaacagaattgaaccattcttttgattgaacattttggaatcactgtttttctagaatctgcaaaggatatttgggagcactttgaggcctatggggaaaaatgaaatatcctcacataaaaactagaaaggggcttccttagaaactgcattgtgatgtgtgccttcatctcacagagctaaacgtttcttttcattgagcagttgggaactctgttgttctaaaatctgtaaacggatatttgggaacacattgaggcctatgctgaaaaagacaatatcttccaacacaaactagaaagaaagtttctgaggaatttctttgtgatgtgcacattcatctcccagagtttaaccattcttctgattgagcaatttagaaacgcagtgtttgtagaatctgccaaggggtattttcattcacctggaggactatgatgacaaaggaaatatcttctgaaacgaagtagacaaaagctttatgaggaactgctttgtgatgtgtgctttcctctcacagagttgaactgttctgttgattaagcagtttggagccactgtttttgtagaatctgcaaaggaatatttgggagcactttgaggcctatggtgaaaaaggaactatcttcacataaaaactagaaaggagctttcttagaaactgctctgtgatgtgtgcattcgtctcacagagttaaaagtttcttttcattgagcaatttggaaactttcttctagaatctacaatgggatatttgtaagcacattgaagtctatggtgaaaaaggaaatatttttcaacacaaactaaaaagaaagtttctgagaaactgctttgtgatgtgtgcatttatctcacagagtttaaccattcttttgattgagaagtttggaaaaacagtgtttgtagaatctgcaaagggatatttggattcaccttgaggcctatagtgaaaaatgaagcatcttctgatgatacaaactagacagaagttttctgaggagctgctttgtgatgtttgctttactctcacagagctgaactattcttttgattgagcagtttggaaacactgttttcctagaatctacagagggatatgtgggagcgcttcaagacctttggtgaaaaagaaaatatcttcacataaaaactagaaaggagcttttttagaaatggctttgtgatgtgtccattcatctcacagagttaaacatttcttttcattgaacagtttggaaactttgttcttctacaatctgcaaagggatatttgggagcactttgaggccaatgctgaaaaaggcagtatcttccagtacaaactggaaagaaagattctgagaaatttctttgtgacctctacattcatcacacagactttaactattcttttgattcagcagtgtggaaacacgtgtttgttgaatctgagaagggatatattcattcgccttgaggcctatggtgacaaagtaaataacttctgatacaaactagacagaagctttctcagtaactgctttgtgatgtgtgcattcctctcacagagatgaaccattcttttgagagagcagttcagaaccactgtttttgtagaatctgcaaagggatatttgggagcgctttgaggcctatgatgaaaaagggatatcttttaataaaaactagaaagaacctttctgagaaattgctttgtgacatgtgcattcctctaacagagttgaaccattctgcttagcagtttggaaccactgtttttctagaatctgcaaagggatatttgtgagtgctttgaggtctacagtgaaaaatgaaatatcctcacataaaaattagaaagcagctttcttagaaactgctttgttatgtgtgcattcatttcacagagttaaaggatgcttttcattgaagagtttggaaactctgttctcctagaatctgataagggatataagggaggacattgaggcctacgatgaataggcaatagcttccaatacaaactagaaagaaattttctgagaaattgctttgtgatgtgtgcattcatctcacagagtttaagcattcttttgaatgagcagtttgaaaccacagtgtttttagaatattcaaagggatatttggattggccttgaggcctatcttgacaaagg

SEQ ID NO: 71 - DNA, 5001 bp, Homo sapiens
gaaatatcttctgatacaaattaggcagaagatttctgaggaattcctttgagatgtgtgcattcctcttacagagttgaactgttcttttgattgagcagtttggaaacactgtttttgtagaatctgcaaaggggtaattcggagcactttgaggcctatgttgaaaaaggaaatatcttcacataaaaactagaaagaacctttctgagaaattgcttggtgttgtgtgcgtttctcaaacagacttcaaccattctgtttactgagcattttggaagcactgtttttctagaatctgcaaatggatatttgtgagcactttgaggcctatggtgaaaaaggaaatatcctcacataaaaattagaaagagctttcttttagaaactgcttcgtgatgtgtgcattcatctcacagagttcaacgtttcttttcattgaacagtttggaagcactgttctcctagaatctgcaaagggatatttgggagtgctttgaggccaatggtgaaaaaggtagtatcttctgatgtaaacaagaaagaaagtttctgagaagttgcttcataatgtgtgcattcatctcacagagtttaaccattctattgattgagcagtttggaaacacagtgtttttcgaatctgtgaagggatatttggattcactttgagacttattatgacaaagtacatatcttctgatacaaaccagacagaagcattctgaggaactgctttgagacgtatgcattcttcacacagtgttgaacctttcttttgattgagcagtttagagccaccgttttttttagaatctgcaaagttgaaccattattttgattgagcaatttggaaccactcttctttttctagaatatgcaaaaggatatttgggggcgctttgaggcctaaggtgaaaaaggagatatcttcacatgaaaattagaaaggatctttcttagaaactgctttgtgatgtctgcattcatctcagagttaaacgtttcttttcattgagcactttgaaaaatctgttctcctagaatctgcaaggggatatttgggggcactttgaggcctatggtgaaaaaggcaacatcaacaagatagaaagtttctgagaaattgctttgtgaagtgtgtattcatctcacagtgtttaaactttcttttgtttgagcagattggaaacacagtgtttgtagaatctgtgaggggatatttgggtttaccttgaggccttttgtgacaaaggatgcatcttctgatgcaaactagacagaagctttctttggatgcattcattcctctcacagaattgaacctttcgtttgattgagctgtttggagacactgtttttgtagaatctgcaaagggctatttgggagtgctttgaggtgtatggtgaaaaaggaaatttccccacattaaaactgaaaggagctttcttagaaactgatttgtgatgtgtccattcatctcacagagttaaacctttctttttacttaactgtttggaaactctgttcttctagactctgtaaagggatatttgggagcacgttgaggtctatggtgaagaaggaaatattttcacataaaaactagaaagaacctttctgataaattgctttgtgatgggtgcattcccctaacagagttgaaccattctgtttattgagaaatttggaaccactgtttttctagaatctgaaaagggatatttctgagtgctttgaggcctatggtgagaaaggaaatatactcacataaaaaccagagaggagctttcttagaaactgctttgtgatttgtccattcatcttacagagttaaatatttcttttcatttagaagtttggaaaatctgttcttctagaatctgtgaagggatatttgggaggtcattgaggatcatggtgaaaaaagaaatatcttccgatacaaactggaaagaaagtttctgagaaattgctttgggatgtgtgcattcatctctcagagtttaacctttcttttgattgagtagtttggaaacacagtgtttgtagaatctacaaagggatatttggatacccttagaggcctatggtgacaaaggaaatatcttctgatacacactgtacagaagcttttggggaaactgctttgagatgtgtgcattactctcacagagttgaaccattcttttgattgagcagtttggaaacatttgggagagttttgaggcctatggtgaaaaacgaggtattttcagataaaaactggaaagaacctctctgagaaattgctttgtgatgtgtgcattcttataacagagttgaaccattcttttgattgagcagtttggaacaactgtttttctacaatgtgcagatggatatttgtgagtgctttgaagcctacagtgaaaaacaaaatatccccacacaaaaaccagaaaggagatttcttagagactactttctgatgtgagcattcatctcacagagttaaacatttcttttcattgagcagtttggaaactctgttctcctagaatctgcaaagggatatttaggagtgctttgaggcctatgttgaaaaaggaaatatcttccgatacaaactagaaaaaaagtttctgaaaaaatttctttgtgatgtctgcattgacctcacagagtttaacaattcttttgatggagcagtttggaaacacagtgtttgtagaatctgcaaagtgatatttggattccccttgaggcctatggtgacaaaggaaatatcttcacataaaaactagatagaacctttctgagaaattgcttagtgatgtttgcattcctctaacagacttcaaccactctgttgattgagaattttgaaaccactgttgttctggaatctgcaaagggatatttgtgagtgctttgagacctatggtgaaaaaggaaatatcctcacattaaaattagaaaggagctttcttagaaactgctttgtgatgtgtgcattcatctcacagagttaaacgtttcttttcattgagcagtttggaaacacttctcctagaatctgcaaaggggtacgtgggagtgcattgaggcctatggtgaaaaaggcaatatcttccaatacaaactggaaagaaagtatctgagaaattacattgtgatatgtgcatttatctcagcaagtttaaccattcttttcattgagcagtttggaaacactgtctttttagaacctgcgatgggatgttttgatttgccttgaggcccatggtgacaaaaggcatatcttctgatacaaactagacagaagctttctgaggaactactttgagatgtgtgcattcctctcacagagttgtaccattattttggttgagcagtttggagccactgtttttgtagaatctgcaaaggaatatttgggagcactttgaggtctatggtgaaaaaggaaatattctcacataaaaactgaaaggagctttcttagaaactgctttgtgatgtgtccattcatctcacagagttaaacgtttcttttcattcagaagtttggaaactctcttcttctaggatctgcaaagggatatttgggagcacattgacgattatggtgaaaaaggaaatatcttctaataaaaactacaaagaacctttatgagaaattgccttatgatgtgtgcatgcctctaacagtggtgaacctttctgttgattgagcattttggaaccactgtttttctccaatctgcaaggggatatttgtgagtgctttgaggcctatggtgaaaaatcaaatatcatcacacaaaaattagaaaggagctttcttagaaactgctttttgatgtgtactttcatctcactgagttaaacctttcttttcattgagcagtttggaaactgtgttttcctagaatatgcaaagtgatatttgggagcactttgatgattatggtgaaaaaggaaatatcttctaataaaaactagaaagaatctttgtgagaaattgctttgtgatgtgtgcattagtctaacagaattgaaccattatgttgattgagcagtttggaaacactgtttttctagaatctgcaaagggatatttgtgagcactttgaggcctatggtgaaaagggaaatatcctcacataaaaactagaaagctttcttagagactgctttgtggtgtatgcatttatctcacagaattaaacatttcctttcattgaacagtttggaaactctgttttcctagcatctgcaaagggatatttgggagggcgttgaggactatggtgaaaaaagcaatatcttccaaaacaaacaagaaaaaaattctgagaaattactttgtgatgagtgcatttacctcacagagtttaactttcttttgattaagcagtttggaaacaaagtggttttagaatatgtgaagggatatttggaatcactttgaggcctatggtgacaaaggaaagatcttctatacaaactaggcagaagttttctgaggaactgctttgagatgtgtgcattcctctcacagagttgaacctttctcttgatttagcattttttagccactgtttttgtagaatctgaaaaatgatatttggtagtgctttcaggcctgtggtgaaaaaggaaatatcttcaaataaaaactagaaaggagctttataagaaactgctttgtaatgcatggattgatctcacataggtaaacattccttttcattgagcaatttggaaactctgttctcctagaatctacaaagggatattttggggtgcctgaggcctatggtgaaaatggtacactcttccaatgcaaactagaaagattctgagaaactgctttgtgatgtgtgcattcatctcacagagtttaaccattctttttattaagcagtttggaaacacagtgtttgtagaatctgtgaagggatatttgaattcaccttgaggcttatgttgacaaaggacacaaatgtcccttt

SEQ ID NO: 72 - DNA, 5001 bp, Homo sapiens
tgcagtttctacaaaaacagtgtttccaaactgctgaatcaaaataaaggtgtaactctgttagatgaatgcacacatcacaaagcagtttctcagaaagcttctgtctagttcttctctgaagatatttcctattccaccataagcctcgatgtgctcccaaatataccttcacagattatacaaaaacagtgttcccaaacagttccatcaaaagaaggacttaactctgtgagacgaatgcacacatcagaaagcagtttctcataaagcttctttccagtttttatctgaagatatttctttgttcaccataggctttttctcactgcttagtatcacttcacatattttgagaaaacagtgtttccaaactgcccagtcaaaaaccagttttaactctgtgagttgaacgtacacatcacaaagcagtttttcaaaatcttctttctagcttttatctgaaattactttttctttcaccacaggcactcccaaatatacctttgcagattcttcaaaagcagtgttttcaaactgatcaatcaaaagaaagttttaactctgttagatgaatgcacacatctcaaaacagtttatcaaaaagtttttttctagtctttattggaagatatttcctttttcatcataggcttcaatcattcccaaatattccttcacagatactacaaagccagtgtttccaaactgctcaaaggaaaggtttatccctgtgagatgaatgcacatggcacaaagcagtttctcaaaaagcttctttctagtttttatccatagatatttctttgttcaacataggcttcaatgagctcccaaatatcccatcgtagattcaaacagtgtttccaaactgctccatcaaaagaaaggttgaactctgtgagatgaatgcacacatcctaaagtagttcttcagaaagcttctgtctggtacttcaatgaatgtatttcctcttccaccttaggccttaatgcattcccaaatatccctttgcagattctacaaaaagagtgtttccaaaatgttccatcaaaagaaggtcttagctcatgaaatgaatgcacatcagaaatcagtttctcataaagcttctttccagtttttatctgaagatattttcttttttaccataggatttatttgcactagctaatatccctttgcaggttacacgaaaacagtgtttccaaacagctcagtcaaaagaatgttttatcactttaagatgaatgtacgtatcacaaagcagtttctcagaaagcttctttctagtttttatccaaatatatttcctttttccacaatgggcataactgtgctttcaaatataccattgccgattctacaaaaacagttttttgtaacttctcaatcaaaagaaatgtttccatctgtgagaagaatgcacacatggaatagcagtttctcacaaaccttctttgtattttttatccaaagctatttcctttttcaccattgcataagtgccatcccaaatattcctggcagattctaacaaaacagtgtttccaaacagctcaatcaaaagaaaggtttaactctgtgacatgaatgcacacaccacaaagcagtttctcaaaaagcttacttctagtttttttctgaagatatttcgtttttcaccataggcttcaatgtgctcccaaacataccttcgcagattctactaaaacaatttttccaaagtgctcaatcaaaagaaaggtttaactctgtgaggtgtatgctgacaacacagagcagtttctcagatagcttctgtctaattcttctctgaagatatttccttttcaaccataggcctcaatatgctcaaaatatcccttcgcagattctgtaaaaacagtgtttcagaacagttccattaaaagaaggaattagcactgtgatatgaatgcacacatcagatatcagtttctcataacgatactttccagtttttatctgaagatatttccttgtacaccataggcctttttgcgctatataacatcacttcacagattatccaaaaacagtgtttccaaaatgctgtcaaaagaaaagtttatttctgtgaggtgaatccatccatcagaaagcagtttcttgaagagcttctttgtagtttttatccaaagacatttccattttcaccctaggcatcagtgggctcctgaatatccctttgcagattgtatgataacagtgttacccaactcccaaattgaaagaaacgtttaactctgtgagaaaaatgcacacatcacaaagcaggttttcaaatagcttccatttaatttttacctgaagttatttcctttttcaccacatgcctcacgtattcgaaatatcctttctcagattctacaaaaatagtgtttccaatctgattaatctaaagaaaggttgacctctgtgagatgaatgcacacataaccaagaagtttctcagaatgcttctgtctagttcttctccgtagaggtttgcttttccaacatacacatcaatgcactccctaatatccctttgtagattctacaaaaacagtgtatacaaactgctcaatcaaaagaaagttctaactctgtaagataaatgcacacatcaaaaagcagtttctcagaattcttctctgaagacatttacttttccaccttaggcctccatgtgctaccaaatatcccttcgcagattctacaaaaacagtgtttccaaactgttctttcaaaagatggacttaactatgtgagatgaatacacatatcagaaagtagtgtatcataacgcttttttccagtttttatatctgaagatatttccttgttcaccataggctttttttgcactgcctaatatcgctttgcagattttgcaaaacgagtgtttcaaactgctcagtaaaaagaaaggttgaactctgtgagatgaatatggacatcacaaagtagtttctcaaaaagtttttatccaaagatatttcctttatcaccataggcttcaatgtgatcccaaatttcccatcgcagattctgcaataacagaggttccatactgctcaatcacaaaacaggtctaactctgtgaattgaatgcatacattacaaagaagtttctaaaaaacttctttctttttttatctcaagatatttccattttcaccacaggcataagtgtgctcccaaatatccctttgcagatttttaaaaaagtttccaaacttctcaatcaatagaaacgtttacctctgtgagaagaatgcacacatcacaaaactgtttatcagaaatcttcattctagtttttatctgaagttatttcctttttcaccatatgccttacgtgctcccaaatatcccatcgcagaagctacaaaaacagtgattccaaactgatcaatcaaaggaaatatttaactctgtgagatgaatgcacacatcacaaagcagtttttcaaaagtttctttctagtttctatgtgaggatatttcttttttcaccataagcttcaatgagctcccaaatatccctttgcagattgtacaaaaacagtgtttctaaatgttcaatcaaaaaacgggtttaattctgtgagttgaatgcacaaatcacaaagcagtctctcaaaaattttctctctactttttatctgaagatatttcttttatcaccataggcttcaatgcgctcccaaatatctgtttgcagattctacaaaaacagtgtttccaaactgatcaatcaaaagaaaggtttaactctgttagatgaatacagcaatcacaaagcagtttctcagaaagcttctgtctatttcttttctgaagatatttccttttccatcataggtgtcaatgcactcccaaaaatgcattttcagattcaagaaaaaaccatgtttccaaactgttcaatcctaagaaaggtttaactctgtgagatgaatgcaaacatcacaaagcagtttctcataaggcttctttccagtttttagctgaagatatttccttgttcaccataggcctttttgtgctacttaacatcactttgcaaattatacacaaacagtatttccaaattgctaagttaaaataaaagtttaactctctgtgatgaatgcatgcatcacaatacagttcaactctgtgagataaaagcacacattgcaaagcagttcacaaattctacaaaaacagtgtttccaaacttctaaatgaaatgaaaggtttaactctgtgagatgatggtaaacatcacagagcactttctcaaaaatcttctttcctgtttttatctgaagatgtttccttcttcaccattgacttcaatgcactcccaaatatcctttcacatattctgcattaacagtgtttccaaactgcttaaacaaaacacaggtttaactctgtgaattgaaggcaacatcacaaagcagtttctcaaaaagcttctttctagtttttatctgaagatacttcctttttcaccataggcttcaatgcccacccaaatatcacttcacagattctagaaaaacagtgtttccaaattgctaagtcaaaagaaagttttaagtatgtgagataaatgcacaaatcacaaatcagtttctcagaaagcttctgtttagttcttctctgaagatatttccttttccaccataggcctcaatgcactgtgaaatatcccttcgcagattctacaaaaacagtgttccaaacttttccatcaaaagaaggaattacctctgtgagatgaatgcacacataagaaagcagtttctcataacccttgtttccagttttcatctgaagatgtttccttttttatcataggcttttttgtgctacctaatatcgcttcacagattataccaaaagacgttttccaaactgctcaatcaaacaaaacgtttaactgtgtgagaagaatgcacacatcatagagcagtttctcagaaagcttctctctagttttc

SEQ ID NO: 73 - DNA, 5001 bp, Homo sapiens
catctgaagatattttctatttcaacataggcctcaatgctctcaaaatattcctgcacccagaaatatctttttggcaattccacaaaaaaagtgtttccaaatttctcaatcaaaagaaaggtttaactatgtgaggtgactgaacatatcacaaggcagtttctctgaaagcttctatctagtttttacaaaagatatttcctcttccaccataggtctcaatccaatcccaattatccctatgcagattatacaacaaaagtgtttccaaactgctcaattaaaaaaatctttacctctctgagatgaatgcacacatcataaagctgtttcaaagaacacttctttttttatctgaagctatttcctttttcacctttgacttcaatacgctgccaaatattcctttgcaaattctacaaaaacggtgtttctaaactgcgtaaaaaagaaaccattaactctgtgaaatgaatgcaaacatcacaaagaagtttctcagaaagtgtctttctagtgcttctctgatgatatttcctttttcaaaatcggcctcaataagatcaaaaaaatcccttcacagattctacaaaagcagtgttcccaaactgctcaatgaaaagaaatgtttaactttgtgacatgaacgcacacatcacaaagcagtttctcaaaaacttctttgtattttttatctgaagatgtttcctttctcaccataggtctcaatgcattcccaaatatacctttgcagattctacaaaaacagtgtgtctaaactgctaaatcaaaggcaaggtttaactctgtgagatgaatgcacacatcacaaatcagtttcttaaatagcttctgtctagttcttctctgaagataattccttttccaatataggcttcaatttgctccaaaatatccctttgcatattctacaaaacagtgtttccaaactcttccatcaaaagaaagatttacctctgtgagatgaatgccgtcatcagaaaacagtttctcataatgcttctttccagtttttatcttaatatatatccttcttcaccataggtctttttgtgctaccaaaatggttttgcagattatatgaaaacagtgtttccaaactgctcagttaaatgaaaagtttacctctgtgagatgaatgactacatcacaaagaagtttctcaaacagcttctttctagtttttatctaaagatatttcattttttaacataggcatcagtgtgctccaaaatatccctttgcagattctacaaaaacagtttttccaaactgctcaatcaaaagaaatgtttaactctgtgagaagaatgcacacatcaagaagtggtttccagaaagcttctttctagtcttgatctgaagttatttcctttttcaccacaggcccagtgaatgcccaactatccctttgcagattctacaaaaacagtatttccaatctgatcaatcaaaagaaagttttaactctgtgagatgaatgcacacatcacaaagcagtttctcaaaatgcttcttcttagtttttatctgaagatatttcctttttcaccatagacttcaatgtattctgaaatattcctctgcagattctacaataactgtgattctgaacagctcagtctaaagaaacttttaactccgtaagagggatgcatatatcaaaaaacagtttctcggaaagtttctgtatggttattctcagaagatatctccatttccatgcatgggcctcaatgtgctccaaaatatccctttgtagattctacagaaacagtctttccaaactgttccatcaaaaggacgacttaagtctgtgaaatgaatgcacacatcagaaagcagttttccataacgcttctttcctgtttttatctaaaagatatttcctttttcactttaggcctctttgcactacttaatatcacttcgtacattatacaaaaacagtttttccaaaatgctctatcaaaaggaagttttaactctgtgaggtgaatgcacacatcccaaagcagtgtcacaaaagcttatttctaatttttatccaaaggtatttccttcatcacagtaggcttcaatgagctcccaaatatcccatcacagattctacaaaaacagtgtttccaaactgctcactcaaaaaacaggtttaactctgtgagttggaagcacacatcacaaagcagtttctcaaaaagcttctttctagttttcatctgaagatattccctttttcactataggtctcagtgcactcccaaatatacctttgcaaattttacaaaaacagtctttccaaactgctcaatgaacagaaacgtttaactctgtgagatgaatgcacacatcacaaagcaatttctcagaaaacttctgtctagttctttgctgaaactatttccttttccaccataggcctcagtgcactctgaaatatacctttgcatattctacaaaagcagtgtttccaaactgcttaatcaaaaggaagttttaactctgtgagatgaatacacacatggaaaaggagtttctcataatgcttatttccactttttatctgacgatatttcctagtttaccataggctttttggcagtacctaatttcacttaacagcttttgctaaaatagtgtttccaaactgctcagtcaaaagaaatgtttaactctttgagatgaatgcacacatcaccaagctgtttcgtaaaaagcttctctctagttttatccaaagatatttcctttttcaccataggccttgtgcacacccaaatatcccattgcagattctacaacaacagtgtttccaaaacattcaatgaaaagaaagtttgaactccttgagatgaatgcacgcttcacatagcagtttctcaaaaggcttctgtctgtttttatccaaagatatgtcctttttcaccataggaatcaatgctctcccaaatataccttcctatattatacaaaaagagtgattccaaactgctcaatcaaaagaagagtttaactttgtgagatgaatgcacacatcacaaagcaggttctcagaaaacttctgtctacttcttctctgaagatatttccttttccaatacaggcttaatactctcccaaatatcccttcacagattctaccaaaacagtgtttccaaacagttgcaagaaagcaaggacttaactgtgagatgaacacacacataacaaagcagcttctcagaaagcttctttctagtttttgtctgaagttatttcctttttcaccattgtcttcatgagcttgcaaacattacttcacatattatacaaaaacagtgtttccaaattgctccatcaaaagaaaagtttaactctgtgagatgaatgcatacatctcaaagcagtttctcaaaaaggctatttctgcttttcatctgaagatatttcctttttcaccataggcatcaatgcgctcccacatatccctttgcagattctacaaaaccaatgtttccaaactgttcaatcaaaagaaacgtttaactctgtgagaagaatgcacacatcacaaagcagtttctcagagagctgctttctagttttaatctgaggttatttcattttacatcttaggcctggtatactcccaaatattttttgcagaatctacaaaaacagtgtttccaaacagatcaatcaaaagaaaggtttaattatgagagatgaatgcacgcatcagaaagcagtttctcaaaaaacatctttctagtttttatccgaagatatttactttttcaacataggtttcaatgctttcccaaatatccctttgcagattcatcaaaaacagtgtttcctaactgctcaatcaaaaggaaagtttaacttagtgagatgaatgcagacatcacatagcagtttctcagaaagcttctgcctacttctctgaagatatttccttttccaccataggcctccgtgtgctcccaaatatccatttccagattctacaaaaacagtgtttccaaactgttccattgaagaaggacttatctctgtgagatgaatgcaaacatcagaaatcagtttctcttaatgcttctttcaaatttttatcagcagatatttcctttataaacatatacttttttcttctgcataatatggcttcacaaattctacagaaagagtgtttccaaaatgctcagtcaaacaggtttaacgctgtcagatgaatgcatataggacaaagctgctactcaaaaaaccactttctagtttataaccaaagataattcctttttcaccaaattcctaactgcactttaaattatcccattacagagtttacaaaaagggtgtttccaaactgctcaatcaaaaaacaggtttaactctgtgagttgaatacagacatcacaaagcagtttctaaaaagcttttttctagtttttatccgaagacatttcctttttcaccataaacgtagtggactcccaaatatcttttcactgattctacaaaaacaacatttgaaaattgctcaataaaaaacaagttaacgtctgtgagatgaaagcacacatatcaaccagtttcttaaaaagcttctgtcttatttttatccgaagatatttcctttttcaccctaggcctcaatgtgctcccaaatatacctttgcagattctacaaaaacagtgtttctaaagtgctctattgaaagaaaggtttaactatctgagatgaatgcacacataacaaagcagtttctcaaaaagtttctttcaagtttttatccaatgatatttcctttttcatcataggcttcaatgcactcccaaatatcacttcacagattctacaaaagcagtgtttccaaaaggctctttcaagggaaagtgaactctttgagatgaatgcatacatcacaaagcagtttctcagagtgcttctgtctagttctagtctgacgataatttgttttccaccatagg

SEQ ID NO: 74 - DNA, 5001 bp, Homo sapiens
caagcatacttgaagatccccaaacaaaatgcttctcttcagaggctgaataacttttcactttggatgtaggtcactgcaaggacagaaggatttttggtagtctaattagctctctccccacgtcattgtcacctaatagtattaattacattgctctttgtgggtgggcttcttcaatcaccttcaaaccttttctcccattcctccactcccaattcgccattactgtgtgtctatcattcttgttacataaatgcactcgactaagatagaatttgactgttggattcacgcactgagcatgatctcctcatccctggatgtaaaggcaggagggattagttctgggaagttgctcaggagagtgatcagagagcagaactgataaagagagcccaggtagagggcagagaggacttgggctctcgagttgagaagtgacctccctggagatgtgtgaagatggccttgaggcagacctggaactgtgagctgagagtggggtctgcaaattcacagatgcttatggatctatctagagtgggtactttccaggaaaggcatagtagaagaattcttggtgaggaatggtctaatgaatgggctctcaaagacttttagagtttttttaatcacaataaaaagaacaggcccatttttgtggatatggagaggggcatacagtgatagggagaactaggggtaaggctgggtgcatgtgattagcccttaatggtatcttgaaggaaaaataactctaagcttagagcatctacctcataaaagaggcaagttaaaggtgtcttgagccttggacatttgaaacatgttttaaaaaacaaactgcaaagtctgggcagtgtacagttaagaagccaacaaatcaaattgtgcccaacaaatcaaagcaaaaagtataagtcattagaaaaagtagatgtagaaataagatttaacttcagaagcaaccaggcaaataagctcattaatgaatagtccactcaaggaacaaataggatttaaaatgcttccagcttctggatggtttaaagccagccataactaagtaactatgtacacagattagaagaaaatggtgcaatgcagtttcttgttaaatctctttaagtttaccaatagcctgaagcatctgtcaaaatcccaggcaggtgctacaaagaactattttaaacttccaaattcagggcacctgaagaagtagaggtgcatgtcattttccctcttgtggataaacagctttgccattcataaatagtgaaagctgttataaacgtataatagttttccaccatatagtctgtgtgaatgtctctgggcttacgtttttttaattgtaaaaatatttgtttcatcatgtatcttttttttttctgaccaaattctaggcacatttttataggaaaaaaatgatcaagcatgagacaggacccctggactctggagaggcactttggtttcaggataatccttaaagatagaacctcgccatcttggacatctgacctccagataaatcctccaaaaagaaaaaaaagaaaagccctaaggaccagagaagtcatctttaacatgcattcttcatactctctcagagaaaatatgcccatggctaatgtgagaggcagagcagaactgaacagaggcttaaatttttctacctgagagtcagaatttgcgtgtggagatgaattttgataggtgtcaaaaagcaactgttggcctttatgctcttacggttacccacacttctagtgagcaactcatgggtgctaatattgggaagcagagccacccaagccaactgtattcaaattaaggtagagagaaaacccagatttggctacttgccagactgctatgctacctctttctcaacttacattaactcaggagtaggaagctggggcaagtggtgaattcttctatttcttctgctactgaccttcctttgaggcccaatttagcccaagatgggtaagaaaagtgagactgctgatattatttattttgacctccacccagaaacatactgcttcagcctttcatcctttttggatcaattgacacaagtgttttttttgttttgttttatttggcttaaaacagtggttatcaattttttttctgcctttggtttgttgaagcaaaagttgctatgagtcacaagctttgcctgctttacatagccatttagctatattacaaaattaaattaaatatattaaaaataatattttataataataaatatattaaaaattatattaaaaattatactgcaggaacaaatgggaagacatggcaccatttttaagtaaagtataacataacatacattaaaaaatgtgccctgatgaaatttcacaaacaacaaactgaatattcccatgtaagccccacccaggtaaagaaatagaaaattaccagaacccccaaatccacctcttgtgcctccttctaatttctttctgagaaagataaccactgttttgacttctattacatatcactttttaaaaatctactttaggctgggagaggtggctcatgcctgtaatcctagcactttgggaagccaaggaaggaggatcacttgaacccagaagttcacgaccagcctgggcaacaccgtgaaatccggtctctacaaaaataaacaaaattagccaggtacggtggcacatacctgtagttccagcttctatattctggaagttgaggtgggaggatcacttgtgcctgggaggttgaggctgcagtgagccatgatcatgccactgcacttcaggccaggcaacagagcaagaccttgtctcagaataaaaataaataaataaataaataaataaataaataaataaataaatgtaaataaataaaaaaattactttgactaaattaaattgtacagtttgtcttcttttgtgtctagattctttcaacattatggttgtgggagtcaatgttgttgctgcagcaaaattcattcattctcattgctccagtatttcatctggtaaacttgccgcagttcacttatcctttctactgtagatgaacatgtggaatgttgacagtttttgcctattatgaataatgttacaatgcacatatcttttgctgaacatatgtaccattagtgttggctatatacttaggagtggaattgatgggccaaagagtgcacatatgttcagcattggtaaatactaaatagttttccaaagtgatggtggcaattaatgttctggttcaagagtttggctctatagtcttaccattacttgatgttgtgccttctacattttagccgttctggtagctgtacaaatggctcaatttttgagaacatatattgtcaaacacaacagttaaaaacttttttaaaaagctatacatatttgtgttttaaagattaaataatgtcctgagagagacaaatccatggatgacctcacaggggaatactagtgacagagaatttctgtacgaacaatgttttgaggatagctggtctaaattattctatgaaagatgtacagaattgctttaaaatgtgggattttagaattttaataacaataaaacatttttcactctgtttcatgtttcatgggcattttgaagaattgtgatcaatacctgattgcaggatatttgatcactggttaagctacatcagcacacaaaaaaagtgctgcaatagggagtctgttcatatgctaaatactctgaagcatttttccctgaggtaatctaaattctgctgtcatttattaattcgccttctatgatttctacaaactttaagttttggaaggaagtctacatgtattatggtattagagctgttaaaatttgccatccattacttaaaaatcacattgaacatattcacaaagtgccttcccctgtgctgaccatgcagcaagatctgataccaaatgtcagaaattcatttggtggaaataacaaattaattggctaagagtagctcaagcaacacgcttatctttctcacataatgagagagacatatttgctggttttaagacatatttaccagctagttgctggtattgtttcagctattcagcaacgtcattaggcatctggctttcaatcattctattccagcatccttaatgcactaactttcatactcatgctgttgctttgtggttgcaagatggctgctctacttctggcatcacatctgcattgaagaagtaaaagaagaaaagagggggtgattgcagctgtatatttcctatttttcaagaaaagagcctccagaagacttctgcttatatctctgtatgaattatctattctgtagaacaaataaccctcaaaatcagtggtaaaacaacaacaatactgcagggaataagacagatggaaagaaaaaccaaataattattataatttccatggatcaggaatttcactgaggcttagctaggtgagtttggttcaggatctttcatggagttgcagtgaggatgttggcaggagctgcaatcatctgaggacatgactggggtccgggaatccacttctaaaatggttcactgccaagatgagccttaccacaggcttcccgatgtgttctcacaaaatggcagctagctcgcctcaaagcaagtgacctgagaggcagcgaggcagaaatcacattattttatgaactagccttacaagactaatactatgttttgagtgtatcttctccaaaattcaggtgttgccaatgtgatattattaagagatggatcctttaagaggtgattaggccaaggaggcttcttcctcatgaacaggattaaggcctttttaaaagaggcttcacgcagtgttcagctagcacactcgcttgctcttctgctttctgccatgtgaggacatagcaagaaggccctcaccagacactaaatgctggtgtcttgatctcagacttccagcttccaaaactgt

SEQ ID NO: 75 - DNA, 5001 bp, Homo sapiens
tgccgtgcgcttgcactcctcagcccttgggcagtcgatgggaccaggcgccacggagcagggggcggcactcgtcgtggagtctcaggctgtgcaggagcccacggcaggggcagggaggctcgggcatggtgggctgcaggtcccaagctctgccctgtggggaagcagctgaggcctggtgagaattcgagcacagtgccggcgctgctaggggacccggcgcaacctctgcagctgctggcccaggtgctaagcccctcactgcccggggctggcagcatcggctggctgctctgagtgcagggcccatggagcccacgcctacccagaactcacactggcccactagcgccatgcacagccccagttcctgcccgcacctctccctccacacctccgtgcaagcagagggagccagctctggccttggccagcccagagaggggctcccacagtgcaacggtgggctgatgagctcctcaagtgtgccaaggctgaggaggcaccaagagcaagcgagggctgctagcacgttgtcacctctcaccaacacacctggctaatttttgaattttttgtagagacagggttttgccatgttgcccaggctggtctcaaagttctgagttcaagcaatctgcccacctcagcctcccaaaatgctgaaattacaggcatgaggcactatgccccacctcaagttatttttcataaaagttggaatagagggtaccaccttatgctgtaatatcttatttacaggagaaaaacaaaacctggtctgttctaggatctgtttccttaaagtcttagtttatgtcacttttagcataagtgactacatttttgtttggtcttgtctgttgggacctagtgtatgagctctgtctaaaacaatggcctcccataattttgtttaaaaattccccctttttggtcaggttctcacttaggtgaaaatatgaccaaaacttagggccttagtgccactctcattaccatcattttgggcatctggtctcagtacatcattcatagcttatgatgtccttgtgatcagacatttcttcaagtttttgtcatcccagttgaagagaaaccatttgatattctagaaatggctgcatgcaaacatttaaaacttttgagagaatacagcatgccagtgacactactattatgactatcaggaggatgataccaagagtttggggtatgctccctagccaggatctccatgaaccaaaccaactaaactaaaatggatcaaagaaagaactagataaagggtctactcgccttaaccaaacagtcattaatctccctacaactgaatctctatactactcagtgtatttctccatggacaacaagaagtgccagcaactacacatatacttctctatttagccagtaagtagtctagagtaatactgttatttagcataactttcacaagagaatttaaagtctactgtgtaaccatagcctttacagtagaatctactatagagcctatcatgagggatacatttctaatcattgcctcatttactccaaactatggaaaaaagagacctaacaaatgatgcccataaagaagagtgaagatctcctagcaatgttatctttaacccatgacgtaggttaagaggagtggaccaatgttctgtttctaattatgtgataacaaatatatcattaaaatttctcacccatgttggcccttcatcttccatctatcaactagtccatatataaggctggttgcaaaatccttcaaaaataaaagtatgccccatgagtacacaacaaaccaccttttttatttctagacataggcaaggaagaaaactgaaagataggaatctcatgatagcagagaaatcttgatctgtgatcttgataaaaagctgtccatgtcaaaaatgctatcttcttctggggagaaacttccctggttaactttaccttaaggtttccaatgggtatacagatccaagagtgtgaaggggcccttctgagttgtgttatgaactcaaggttcaaggtctcaaagtgttgctgcagtgtggatggcaaggatagtcattctctggtgttctcagaagatcaaatcttcaggtcctaggctgtgaaggggttgattgtcctcagtcagtggaccatgaagagcttttttttttttttcagacagagtttcactcttgttgcccaggctggagtgcaatggtgcaatcttggctcaccacaacctccgcctcccgggttcaagtgattctcctgcctcaggctcccgagtagctgctattacaggcatccaccaccacacttggctaattttgtatttttagtagagacagggtttcttcatgttggtcaggctggtaattatatataatatatatatttcctacctttgacatatataaaatatatataattatatctattattatatattatatattatatattatatataacatctatatactatatactatatatttatatttaatataataatgtattatatattaaatatattattatattttatatataatatataattacatatttaatatataacatatataaaatgttatatattttatatataatatataatatatacaatatattataatatataattatatattataatatataatatacataattatattatatattatataatatagtatatatatttatatatatttatatataaatatatatacttataattacataaaattatctatataatttatatagtacatataattatatgtaattataaatataattatatatactatgatacatatatactatatataatatagtatatatatacattcaacgtgtgtccgtgtttttcttaaaaaaggaaaacgacaaaggaaaaacaaataatggatggctgttgtcaatggaaactgtaaggagactgtgtcctcactgctcacggattgtttattggtcaaaggcctcaggaggcccaggacacttcacggccatcacggtaccaactgcagctatcacctttttttttctttttttcattttctaccttttgacatatataaacacatatattatatatactatatactatataatatatataattatattatatagtatatagtatatagtatatagtatatagtatatagtatatgttatatattatatattatatgttatatattataattataatatataattatatattatataaattaaatatattatatttagtatattatatataatatataatatatattatatatgttattatatttattatatataatatatattatatatattattatatttattatatataatatatattatatatattattatatttattatatataatatatattaaataatatatattatatatattattatatttattatatataatatatattaaataatatatattatatattataatttatatagtatatataagtatataattataaatatatattttatataattatatataaaaataaatatatataattatataatatataacatatatattatataatatatatttaatatatattatcttaaatatatacaattatatattataatttatatggtatatacaattatatattataatttgcatggtatatacaattatatattataatttacatggtatatatgattatatataatttatatggtatatacgattatatataatttatatggtatatacgattatatatattataatttatatggtatatacgattatatatattataatttatatggtatatacgattatatatattataatttatatggtatatacgattatatatattataatttatatggtatatacgattatatatattataatttatatggtatatacaattatatattataatttatatggtatatagttatatattataatttatatagtatatacaattatatatattataatttatatactatatacaattatatatattataatttctatagtatatacaattatatataattacaaatatatatttttatataattatatataaataataaatatatataattatataatatataattatataatatatttaatattatattatattaaatatataattatataatatatatttaatatattatattaaatatatacaattatatatattataatttatatactatataaattatatattataatttatatactatataaattatatattataattgatatactatataaattatatattataattgatatactatataaattatatattataattgatatactatataaattatatattataatttatatactatataaattatatatagtatatatatggtatatggtatatacaattatatattataatttatatggtatatacaattatatatattataatttatatagtatatacaattatatattataatttgtatagtatatataattataaatgtatatattatatataacatatagtaatatattttatagaattataaattatatataatatataacatatattatatataattataaattatattattatatataacatataataacatattttatataattataaattatattatatataccatatattttatataattataaattatatattatatataacatatatttcatataattataaattatatataatatataacatataatatatttcatatacttataaattatatattacatataacatataatatatattatataattataaattatatattatatattatatataacatatacatatacattatattatatattatatagtatgttatatatactatatattgtatatagtatatatacaatatatattttatatgacatactatatattatat

SEQ ID NO: 76 - DNA, 5001 bp, Homo sapiens
gacaagagtcctactggattagggtcccacatttatggccacagttaacttatttgccctcttaaaatccctctgtccaatacagagccactgggattggggtttcatcacatgaatttaagagaaagacacgatgcagtagatgacgccaatcaagggatagtgagaagccttagaatattttgcttgtcaagaaggtaaaatgggccttgtgggaatttgttgaaaaaagggtgccagtgactgttaaaacctgcagcaaggatgtgaggaagtagaaccacagataataaagaaagaggagtcctggggacagctgaggtgctggggaggagggagaccactgagctgatgaggaagccccgccctccctgcacctgctcctgacccggcctcctgctctgtgggccccgcgcgccccctgctcgtcctgagcagcacctgcgccggctcctccgcctccctgcagggaggtttgtgtctgggctcacactcacctcccctcactgtgtttctcgcacagtaatacacggccgtgtccacggcggtcacagagctcagcttcagggagaactggttcttggacgtgtctactgacatggtgactcgactcttgagggacgggttgtagtaggtgctcccactataatagatgtacccaatccactccagtcccttccctgggggctgccggatccagccccaccagttactactgctgatggagtaaccagagacagcgcaggtgagggacagggtgtccgaaggcttcaccagtcctgggcccgactcctgcagctgcacctgggacaggaccactgtgaacagagagacccacagtgagccctgggctcagaggcacctcccatatctccatgtctgcagccttgagacactcacatctgggagctgccaccagcaggaggaagaaccacaggtgtttcatgttcttgcacaggaggtccaggactctcagaaagtatttcccatgtgagcaggaccctgaatttaaggaaatgtgtgatggtttcccttgggtgcctaagtgagatttgcatgtgggtggtgcctctgtatggagaggtgaaaagggatgagggaggccccagtcttttaggctctccctggaaggaggatgctggttgtgccctctgagaattcagttatcttcctggggcctcaactcactatgtcctggctcctcttttcccaggtgaggaaacagattgcaacagcagcttaatgtaacaatcatgtgagttcagacacaccaggattcacttaacgttatttgtagttcagaacctctatcaggtttagagggaatcgctctgtgccagggagtgggtcttaaatagcaaaacggcctcagaaaacccaacataatctacagcgagacctcagcatggcaagcaaggaatccctaaagccaccagggagctccggatgcactgatacggcccagacacatggcgagtccaggaactgatggggactttgggggagcctcttttattattttttaggattctgtggttgaaggtcacaacactgggcctgactgcttcctgaaccaagcccagcacaatatggttcaccccagtgacattttcagatgtttcttcctgtaatgaaagcgcggtgtgatgtgtatgcacctatgtgtttacctaatgaatgtaaagagaagcacatttcatgcagctgtattttcataaatgtcagtcattcatcatgttagtgtctatttttccataaatctgtacagaacaaattattcattcattgatttgtaatagtcttattgagacattattactatacattaaatattgcaaaaagtgtgcggtttaataagtactcaagccaagcctgctggcaaacaacggtagttccagctacttagatggcagatgcaggagtattgttggagaccagaagttggaggctacattgaactatgatcccaccactacactccagcctgggtcgcagagtaggaccacatctcttcagaaaaaaacaaacaaacaaacaaaacaaaatgttattccactcgtgctcacctgtgcatccccaaaagccatccaaataatgaataaacaaattacacttaaaagtttccttgtgttcctctacaattcctccttcccaattattttcttcctccaccatattctgagtcagtccttcacatttaataccttagttttgagtttcgagaatttattatacaggaattacatagtatgtgttttatttgtgtggcttctcgcacataactacttatgatgcacacatgttgagcatcaacaatgtattgattctaatgatggatgttattaccataaattagcatgccattactgtttatctatgtatcttcttggtatttgtaccatttctagttgcttagtattacacagaggtgcttctcagcttggagatgtaagcaccccataaaaatatgttactattcttataacaaatactaaacttactgatctgcaaattagcatatatacatcaaatttttgatgttataggacaaacaatatatctgaaatctgaacagacataaagacttgcagggaaataaacaggagcagatgataatcttttctgggacagaggctgccaaatgtcatttaagttagcacacgattaaagtagacatattcattgggtggtttcaatttgagtgtgatagagaagttattgtttaaattctcagagtgtatgcagttgaggaattcctcctgctattgaagcctttttcttcagtactggggatacatcacaaaatgctccagcctctaccccttgggatggtgctgtctgggaaagcaaaacagcaactacagctgaaatgcatccagacacacctccccatcaccactacattgcaagagaaattatctgcagaggtaaagccatcaaaaccactgttctacagacactggagaaaccaataagaactgggaggggagagaggaatgcaccaagtccctgtccaggcccacctcccatcttccctcaggagtaacagccttattcaaaaggaaaaggcagaaactgaagaaatcagtgggaagacatagtggctgctgaaggaatatatgaataaaaacgaagaggccaggtgtggtgcctcacgcctgtaattccagcactttgggaggctgaggtggaaggatcacctgaggtagggagtttgagaccagcctgaccaacatggagaaacgtcatctctactaaaaatacaaaattagcggggcatggtgtcacatgcctgtgatcccagctactctggaggctgaggtaggagaatcacctgaacctgggagggggagattgcagtgagctgagatggcgccattgcactccggtctgggcaagaagagggaaactccacctaaaaaaaaaaaaaaaaagaatgtaaagaaccggccaagtgtagatgaagggccctggaaacctagctacttgctagtcaggaggttgaggtgggaggattctatgagccaggaatttaaaatcaccgtgagctatgttatgatcacaccactgcagtccaacctgcacaagagagtgagactccgtctcaaaaaaaaattaattaattaagaattttacacaattgtaaagctactcaaatagaggaagttaaactgcgcatcctcacatatcatcaggcacttctgatattttgaagaagacaggtgacctaagaccttcagaataagctgatgatctcaaatcatgagaagcttccacacaagacattggaccagaatcctcctccatatcctactcattattctttgcttataaacagtcttctcattttctgcagacctggctgttgtccacccatattggagtcttgtctcttttcttactcatcatttgtatacttgctatttagagtaagtcatcagactctgtgtttaggcctgactgctgataacttcaggctcattcctccatcatctctttttttaagcatacaaggtaaatctagttagaaatcacaggagctccctcatttgatgccaatttggccttgaaaccccacaaaacccttcctgcaagtaggatgctctgccccgctccccaccaaaccatgataacaaccctgagccagtctccttccctgccctatcaagccactttggaccttaatgagagacctgccctgctctcagcagacaccttaaggatgcaggtaactatcctttccatactcacttggtgtgagtgtgtggcataatcagactcaacatccacagaaaattttagttgagatctcttggcattggcatggtgtcggctacaatggatgctgggagcttggtgtcacggctccttccaaaggacatgcctgctccctgagttaactcccagacgcagttggacaggcctcctggggtctgagaagctcctttcatgtactgaaatcctgtcattatgtttttgtattctagtgtctccctaaaagtacagtgagacccagggtccattcatgtgtgtattcaggactctctgatttttatgtattttattcatctctctctactaccttttctaccaaactagacatttaaaaaattgcaatattttaatgaggtgaaattagcaaataagaatctttacataaagtgtacaattttacaaatattgacataatcctcacttttactaacagagaaaaaaatcaattatcctagaaatttccttttgttctcctgtagtttctcctttctataccttctcttcttgtaccatgtccccagtcaactacagatctttttatgtaactttaagttcatttttactttatagaaattatagaagtggaatcgtatgtatgcacttttatttgtctgacttattttacttattcaagtacttgctattttaagcatggtgttgggtgtatccagcattacttgattgtagcagtgggtatgattccagtaagtgatttttccacaattt

SEQ ID NO: 77 - DNA, 5001 bp, Homo sapiens
tgtttaccagttaagctgctgaataacagttggatcgcttttggtctctgggtataataaacaaagatgctacttagcttagagaagtgacaagctgagaaaacatggttcttatttttacataacatgaatagcaggcaaagcagaaaagctgcacactaatcaatttgcttcaatacatcacataattaaagttgggaagctctgtgtgtgtgtcagttcacgtgtttttgtgtgacagaagagagaaggcaggaggagagaccatgccaaaaggagaccctacctgttttgaccataatgtgtgaggtactcaagtaaatacagggacttagtgcttgatggacaaggtcctcctcagatggagaagacaactggatgcacctccatatgggtacatattagtatttacataaatgccattttctaatcatatcaacactccgacacattataagagatgtattggagggtgtctggtggtgaaatattatggtgagaacaacccacatctacagccccttttctgccctgttgcacttgccctgatgcgaacttgatcctgctcatcctgacccctaacaatcatcctaagcccccatactgccccgaatgccccctgctgctcctattcacccctgcagggagggttgtgtctaggctcacaatgaaggcccttcattgcgtcttttgcttaaaaatgcgtagttgtgtgttcactgggcacagagctcagctgtaagaactgtttcttggatctggatatggactcttgagcagtgggttgtaatttgtgctcccttcacaacccatgcacctgatccactcctgtccatcttctaggggcaagcagatacaattctagcaggaaacactggttatgatggggaatccagagacagtgcaggtgaggagagggtctgcaaggagtctcaagccagaagtgtgctgagaaacatagttgttgatgttaacaggttctgggcaacacagtgaaattcccaaaaccacacatttttatgagaataaagagctcactttgtccaatttgtgagtctcctagaacaattcagtagatttcgaggttaggttaaaaagtattatcacatgttcctttcctcaaacttgcaaccaaataaaaaagagaaactgccgttagaaaaatgaaccttgaattgttaccatggtgtgtgataacgatgatttttagaatatgattgacgtgtgataacgtgaagactgtcctaattccgagccacaattagacctgagcagcaatcacagggagtgaaacacctgactcagtgaagctgcacctgggggtctccgcaggccctgagtggtacaggaacagctcctccctcagactcagtctaaggagaacttctgctctttatctggggaggtgagggtgagtgcgtggaaagtaccaaacttgctctaatcaagatctctgcatgtggggagaaccaaagtatacgagaaacaactggtttcagtttagatcgaacagtttctcatgagaagggcagtaccatgtctggatcctgcacagaattcagaaacaatgaacttggggtaaagttgaaaattataattgtttgcagattgtgttattaattatctatgtcatctgagaaaatgaattaaatcacatggttttcatataaaaattgacaaagcgtgctggccctgagaatgcacctcaaatccctccaatatccaggagcccaatagaccaggcagccagctgctgcactgcactctaacacccatcaactgtgtgtgccaaagacacccatcctgggagctcctcccagacaatggctgtgcacagtggagagattgaggcatggctgctgctgggacacatgggagatccctgatggacaactgtgctcagcgaggcaccaatggccttgctggacttagcttggaccacggggtcatcagggaagctccatcaaactcccacccttctccagcactagttgtgggtctggcattgggggtggcagtgtctacagacacacccggctcctatgcatttttatgcctccaatacttacatctgtttttaggacatatgagaatatttcctctttcaaattagttttctaatccagcgacctcatggtgggcacaaaatataaatgtacagaggctcagaggggaaatattagaagcagaggaaaccacagatcctgaaggaaagcagcccttaccctccctccatctgcacctgccttggggctgcacctgttttgtgagtgctgagtgtcccctttggcccagactcctttcttctttttgcaggaaattttgtgtctggactcacaccgatgtttcctcacttggaaccttatgtacagccatacacagccatgtcctcagttctctgactgttcatttgcagatacagagagttcttagcattgtctttggagatggagaatctgcccttcacagagtctgcatggtgtatctgacttccatcatcttttatatctattactcactccagccccttgcctgcagactggtgaactgggctcattcagaagctactgaaggcgaatctagaggctacacaggagagtctcaggaacttcccaggttgtctcaggtcctctgtgggctctatcagctccacctcacactgaacacctgaaaatacaaacaaatcctggtcagaaactggcaaacatatccactgtttctctcactcatatccactcactctcactcactctagttccctatgagttaccttttaaaataccaacaagaaaaattcagcttaattcacaccccatagtgagttctctgtgttcagtcctgattaccaaatggaaacccctgggaatcccagggctgtggctcttctcccagagctgcagggtcaggtctgggcttgttttcaccaggagaggggccctccctcctcctctatagcaagctccagtgtgggatgcctgagaagaaggcagtgcccaaagcagacgtcagactccaggaggagtttagtggcaatggtagcatttggaaaaatattacttataatgtgactgtgccataaaactcatttagcaattatgatttttgtttttacacatgtgtacaaatacaaatataactgcattaagcaaactgtaagagatataaagaaatagaaaacaatacaaaaataacacaagaccttaatacctcatgaccataatgtatagcaaatccggaaagaaaattcctaatgtgcctctgaacttgaacaacactattgaacaaatttatctgaatgatatttacagaaccttccaaccaagagtcacgtaatacacatccttctcaagaacacattgaacattctccatgatgggttatatgtcacatcataaaatgaaccttaacatttaaagaagtaatgccagcccttctgtaactctttcaaaaattggtgaggagtccaccttccaaactctttatatatatatagtaaataaactttatgtttctcagagatgacactgtaaacagtcacagatttgcatacaatacaattatgtattggctatttacaatttacagtagtggttcttcctctgagaaatataagtacaaaagctaagtaaacaatgaggtactgccatttgggatttattatgtgtcatagcttaaagaactggcctttagcaaatattaaacaaatcaacctgaataaaatagtcaattaaatgatttatttttttctaatttattagaaaaaattccaccaggtttcacctcaaaatgtattgcatatgtctaaaaacaaacttaaaaattaaaaggaaaaggtaagcagttcttcaaaaagaatggaagaaaggaatagaatgaaagctcataaaccaggttaagtcattctgaatatcttttaaacaacataaaattcttcccaacagaaaagtgaagaaaaaactatcaccatttctccactgataaaatctattttaaaggtagtctgccatatatcttctaaactctttctatgaggctaccatgatagtattaccagtaatagacaaaggcaccacaataaaagaaaactacagaccaatatcattagtagacatgaattaatccccaacaatagtaaactaagctccaaagtgttttagaagacatacaccatgaccaactcaaatttcttcctgagatgcatacttgattcaacattctcaaatcaaccaatttggtacaccacattaaaaaactaaagaaaaaatacctcagtaacatttcatcagacacagaaaaagactttgaaaaaaatcagtttcattataaaaactatgaacaaagtaggaagacaagaaaacaacttgaacataataaaagccgttaagaaaggccacagctattattacactcaatagtaaaaggttagaatattttggtccaatatctgtaacaaggcaagaatgcaagctttaggcatttcacttccaggccttaacatttgttagaaacatagaaagttttggcataaatacctatacagagcttagatataaacccacatattgatgacgagctgatttttagcatgagaaccatcaatataacatggctaaattgtagtgtcttccaaagagggtggtatgaaaactggattttcccatgaaaagaattaagaattttaggttagaataaacacaaaaattcactccaaatgcctcaagggtctaactttaatacctgtaattgtaaaactctcaaccctcaaaaaattagcaatctttttctggattttacattcaaatcacctacaaaaaaaaagcagaattgaacaagtgggaatagattatgaaaaagattctgcaaagcaaccaagtaactacaacttacagaattggataatatgccatatatctcaaaaagttttaatgtccaaatggaaaagaaacttctacaactcaacagcaaaaagaaaaatagcctcatttttaataatcagtttta

SEQ ID NO: 78 - DNA, 5001 bp, Homo sapiens
acacctttaacactgtaagaacctagaactcaggttaatgtttttctccatgggcaacggtccgtctttgggtctacttagctggacaatactgtgtattgatttgacaaaacactaatccaggtggtggtgtgaatttttaacagacgttattgaaactggaatcggttgactctatgttaggtagattatcattgataacctgcttggccctgattccatcagagcagaactggagaaggtaaaactccacggtgattaagcagcttcagctctttctgagacttccagcctgcacttactgatggccggccctgaggatattggatgttccagccatctcccaaaattgtcatcccctgcatctcacagggaaaacatcttccttttgcaaaaagcaggaaaaacaaatggaaaaaggagaaaaacgacgaaaaaagaaagtaaatggattaggaacaaaagaagcaccagatcggtgctgatactgatttgcatactttcgtgtcaggagaaggatcagacgtgaaatctgtgaggttctacatgacgctgaccctggttcagcctctctattgtctgtgaccaggatccataaagactgttccagtcagggaatctcacggaggtccctgtcctgggtctgattggagaagactcaccaggaagccctgaggttactcaggactctgatccttgtgaccatggttgaggaattttcatccgtgtcagcgtcaatctgcattttgtgccagggagaaaaggtcctcatatgcatagagaagacattgttaggcacagttttctaaatttaagaggttccctggggaactgtcagaagaagacaaagtcccacatcctgacaggaaacagcctccatctgcacctgcctccagggctgactctgatcagtggctcctgagcgccccctgccgctgatttcccgccagcgttcctgcagggaggtttgtgtctgggcgcacaatgacttcccctcactgtgtctctcgcacagtaatacacagccgtgtcctcagctctcaggctgttcatttgcagatacagcgtgttcttggaattgtctctggagatggtgaatcggcccttcacggagtctgcatagtatttattacttccatcatatgatataactgccacccactccagccccttgcctggagcctggcggacccagtgcatgccatagctactgaaggtgaatccagaggctgcacaggagagtctcagggacctcccaggctggaccacgcctcccccagactccaccagctgcacctgacactggacacctgcaaacagaaggacaccgttatcagaaaatgccacacaaatccagtttttctcactcatgttcactcacactcagtctctctatttctccatgaatcacctcttaaaagagcaacgaggaaaacccagctcagcccaaactccatggtgagtcctctgtgttcagtgctgatcaccgaatggaaacaccgccgacttctagtgctgggctcctctcccagagctgcagggtcagggctgggctggttttcatcagtagagggagggccctatttgcatgtcccccactatatagcaagctctgggtgggacatctgaggagaggctgggctcagggcagatgaagtgtcctgggggagactggtagtaattccatcattcaggaaaatatagttatatcttatatgcttgtgccttgattaacacttagctctcataactttcttttattcttacatatttacacaatatatttaatgcaggcttcaatgttatattttacaggagataatttacatagagaacacagcaggtgtgcagtgtgtctaagataacacatctaaaaatttagtcctattacctgggcctgtgctctaacctctggaggaggcagctcccctgagacaactccaggggagtatggcccatgcctagtgaagtctgcaggattccccatctgttatgacaactctctgttatttacctaaatacgcagagtgaaccacggcacatgtgtatgtttggggaagtcagttatattccttgtgttaatatcgatctatttattgctgcaattcagacaaatattatctcatcagtttctttattgctttattcgagtgtaattaataaataattcaaatttatggtgaatgatttgaaaaatgtagacctatgtgtgcaaccatttactcagcacttcaatcaaggtgtgaataaattaatccctaaatctttctcttattcctctgaaatttaactcacatccccattactcccaatagcatattctcagaaacatataaatcttctccatgttaatttataatagtggcatcttctaaaatttctacaaatgtatcatataaaatttactcttcattccttagtttctttcactcagcacaattctttgagaatttagccatgtttttttcaatgagtgaggcatgacttgatttcaagctgcattagattccagcacagaaatatatgccaaactatttaactgttcacctgtaacgaaatgtgattgttctctcagttaatggatttgatagagaaaagcagctactcggcatgggaatgtaaaaatgtgtaaactatgagcttattctgacctcattaacaacaaagctgaacaactacaaataaaaaaaagaaaaccttcaacatatctgtgttgatgtcagagagaaaacaaacaatacacaaaacctgaaatctgaggagagaggcggctgcagagagaagcaggacccatgtattagtgtacctggggcagatgccactggatggcatttaagatcggaacaggctgacttggacatattcagtgagttgcgtgaggatgcacgtgctcatagtgttagactgtgaagctcctggtgcttgcaggcttttcctacagaattattattaatattcttgctgcactttatgcaaataatcaggccaagtttaagactaaagtttattttgcaaacaactcagtcttatcattatttgctgctgacaaaaaccaaaactggaaagagaaacattgtatttcaaaacatatcatacacttgtctttaaattctaatctcttcagttgtttaagtatttgcctgcattttagactaactctgcttattcctgagcgccaatcaatgatctctggctacagcccagaagaaacaaaaagcgatggggaatataaaaaatctggatcaatattttaattctaagcaattatcctttaaatcatgccaggtgatgggaatgaatagggtgcccctaacctggaggtttctttgtttgggaaaataaatcccagggagctgacaaaagccaagccccatgcgcccaaaccttagcaggcataactacagctgcagttatctaggaatgtcagcagccttggaattttctttcaagctgtccttgccaccttgtttggttttcatacatgtcttctaataaccagatttgcctcttctcattttcagaccatcaaactccaaatggtcatgcaactgaagcctgggataatggctcccttttcctggggtcccttagacctccaagagagatcttccccaaacagcatccctcctcagctggaagcagttaagacttgtctttgtctctattctaatgacagttagatgtacttcttcaaagaggaaaatgctagaggtagaaggcagagaactctcctaggcaggtagggaagagtccccatagaatctccaacgccccagggtcatagtgcacagggagttgcctagacatgcctgcagtgaaaattgttaatgttgtctttatcactctcggaataaatagccacacataataatctagctgcatgaagataaaaattaactagtttgaaattagaacaattccctattcacaatagcaaagacttggagccaacccaaatgtccaacaatgatacactggattaagaaaatgtggcacatatgcaccatggaatcctatgcagccataaaaaatgatgagttcatgtcctttgtagggacatggatgaagctggaaaccatcattctcagcaaactatcgcaaggacaaaaaaccaaacaccacatgttctcagtcctaggtgggaattgaacaatgagaacacatggacacaggaaggggaacatcacacaccggggcctgttgtggggtgaggggaggggggagggatagcattaggagatatacctaatattaaatgacgagttaatgggtgcagcacaccaacatggcacatgtatacatatctaactaacctgcacattgtgcacatgtaccctaaaacttaaagttaaaaaaaaaaacaaccagagaagtgggaaaaaaaaagaaattagaacaattaccaataaaatcaaagttagcatgtggtttataatattaatagacaagagacatggctgaatgctaagaatgtgttcacatctactttatgtcatgatcaggaaaatattttatatattctttaggtaagagtcccattgagaggattaacattgatgtataatacctcaataataaaagtaaaggttattaactagtaatttctattaagaacacaaactttcatttaggatatattcttctatgtgttaggaaatcaactcagaaggcaggaaacattgaacttattagagatgtttaataaattaaaaatgagaattaagtacgtatgcttttagagggtgcacaactttggaattttttgtgtcgttttgtttgagacggagtctcgctgtgtcgcccaggctgaagtgcagtggcacaatctcggctcactgcgacccccgcctccagggttcaagcaatcctctcacttcagcctctcaagtagctgggattacgagtgtacaccaccatgcccggcgaatttttgtatttttagtagaaatgaggtttcaccatactgaccaggctggtctcaaactcccaacctcgagggtc

SEQ ID NO: 79 - DNA, 5001 bp, Homo sapiens
ccacccacctcggcctcccaaagtgctgggtttacaggcatgagccacagcgcccagcctggaatatttttagaaacagagagggttcttacgtcttctggaaatcctattgagatggacaacaagggaagaaaccctcagatgaatttctacctactagagggctgattaatatcattttaaagcaaatgctaacacacaaaaagctaacatgaagctaaaaaaatatagtgattcaatacagcaaccattctagctcaatctagtttaaaatattatctaaccatggagggcactgtcattgttcacagaagacagagtcaatcccactcacaaccttctgggaatgtttaaaaaatggcatccctacataaaaattatcaattttaatgaaatgtgaacttccttggccaagggttctcccactagcactatggaatcatggttcactcctcagggtccatcagttattaccctatgacttggtagctaaaaggcccatacgtttatagattttacaccaagggatcatctttgttctattgcatgcatgtgttacaaaatacggaaagggattcctatgtgatatccactccaatcatgaagagttaaaactgcctttttactacatcttttccgcagtgtcttctgatcttcaacaaggaaactgaaaggaatatcggcagaaaatactgctcttgaatcatattggaaggaatcttatcaggaaacttttaactaactcactgcacaaaacagtcaggcagttaattattggcttcatgttttacaagtaaagaatcaattcaggacagatgcagtggatcttccctataatcacaccactttcagaagcaaagtgagggaaatcacatgagaccaggaaatcgaagccaacctgggcaacataaagagatgctatttctatgaaaaaatattttaaagaataagcaggtgaggggtggcattcccctctaattctagatactcaggaggctgatacaggaagattacgtgagtctggaggtcaaaattacagtgagctatgatcacacaactgtactttaagctgtggaacagtgtgagagcctgcctctaaaaacaaaccaaaaagaatcaattaagaattccacacaactgtaaatctactcaaataggagatgctaaactgagcatcctcattgattgcctggcatttctgatgtttttaagcagacgtgtgacctaagacctgcagaataagctgatagtccttgattgtgagaagcttctacccaagacattcggccaggaccctaattccccatcccctccttctttctctcattattatttccttatatttctaaagtcatctcatttctgtagatctgggtcttgtccatcgatactgaacccttatttctttttcattatttttattcttgctacctagaataagttgtcactctatcttttggtgcatgcctgttgattacttaaggctcactcctccatcatctccttttttgccacacaaggtgaatctagtttggactcacaggagcttcttcattcaatggcagtgggagtttcaaaccttataaaccccgatctgtgagtgggaagcctcactctgccgccaccactaaaccattataaaaaccctgagccagtctcctttcctcttctttcaagccattttagattttcctgtgagacctgccctgcactcagcagacacctacactgtgcagataatacacttttccatattcacttgctctgagcttatgacttcatcagacatgacacacacactaaatctcagttgagatctcttggctttgcatgttgtcaactacaacggatggtgtgagcttggtgtcactgtttctttttttttttcacagacgcttctcaaaagaagacatttatgcagccaaaagacacatgaaaaatttctcatcatcactggccatcagagaaatgcaaatctaaaccacaaggagataccatctcacaccagttagaatgatgatcactgtttctatcaacagtacacactggatccctgaaacaactccaggacacagctggacatgttgctatagatttgttttgtgtccccacctaaatatcatctcaaattctaatccccacatgtcaagggagggaccaggtgagaggttattggatcatgagggcagttttcccatgttgttctcatcatagtgagtgacttctcacaagagctgatagtttaaaagtatgtgtcacttccccctctctctcctgctgcgctgtgtgatgtgccgtgcttcgccttcaccttccaccatgattataagtttcctgtggcctccccagccatgcagcactgtgagtcaactaaacctcttttctttgtaaaatcctcgtctcaggtagttctttataccactgtgaaaacgaactaatatcacatgactggtggagtttgataaactttcttaatgacagtttgtaggggggttgatagggtttgaaacaaccactggcattgaatgaagcagctcctatgagtccaaactagattcagcttgtgtggcaaaaaaggagatgatggaggagtgagacttataatcagtgctaaaggtagtactaattatactaggtaaaatttggtatcaaagcaattagacagagataaataaaatacatgaaaagtcagaaactcctgaatatacacatgaatgagtgctgaacatttctgtatttttagagaaatgctagaatacggcaaaataatggcatggggttaaataaaaaaataatagtctccacacgaagtgttcaattttacaaatatggtcacagacattatcattatccacatagataacaagtcaattaccctcaaaatatcctcttgttctgtaattcctccttcctagaccttcccttctcctacaatattgacagtgaactactgatttttatgtaactttagattacttatcaatacatcaggtaataaaagttatagatttatgtgtgttgtggggtggctgtatataagtttctgtgtgagagagagaaggagggaggaaggaaggcagaaaaagagaggaatcctacataattgaccacaatttatgaggttctcaagtaattatggggaattagtccttacagacaaggctgatataagatggagaggacaacttgacacacctagctatggttatatatttatatcaatatcattttctaatcatacaaacacatgcattagaatagaggtagtggagggtgtctggtggtgaaacatgatggtgacacaaaacgcctcatccagctccttttcacaccagctgcacatgccctgaggttgagccttggacctgctctttctgaatcgccacaataatcctgagccccccgctgtaccaagcacccattggtgtcctgattttcccccatggttcctgagagcccccagctacctgcatgcctctacaatggtcttgagtgccccttggtgtcctgagggagcctggtgtcctgagtaaccctggctgtcctatgcacccccacagggaggcttgggtatgagttcacactgtggtttcctcactgtgtcttttgctctaaaatacatggctatgtgtttgttcctcacatagttcagctgtaagaagaactactttttggacatggatctggagatggtgactggactcttgagaagaggggagtaatttgtgctccctccatgacctatgcacccgatccactccagtacctcccatgggggcgctgatggatgcagctccagcaggaaacactggttgtgatggagaatgcagagatggcacaggtgagggagaggttctgtgaaggcttcaccaggccaagagtgcaccgagaaatacagttgttggcagccacaggttctggagaacacactgaaatttccaaatacttacatttctatgagaataacgagctcacttgtgctcaattagtgagtctcctagcataatgcagttgatgctgatgttggattcagacaaatatagggtcacatttttctccatacttggaaccaagtaataaagagaaacttatgttaggagaatggccattgaactatctctgatcatggtgattttcagaataggcttgagatgtgatcacctaaagagtgtcctaatgcttaaccaacaattaggcctgagcagcagtcacaggcactggaggtcgcccacatggagaaatgtctgactcactgaagctgcacctggggggtctctgcaggctctgagttgtgcagaaacagctcctcccttagactcagactgaggacaatctctgctcattctctggggaaggtgagggttagtgtgtggaaagaacccaacttactttgctcaagatctctgtacttgaacagaaacaaagagtaggagaaaaaatgatttcggttttacatagaataaattatcatgaggaaggcaataatatgtctggatcttgcacagaattaagaaacaatgaatttggggtaaagttgaaaattacaatttctttgcagattctgtttttagttatctatgtcatctgcgaaaatgaagtaaaatcagagtttttatataaaaattcacaaacagcatgctggccccaagaatgcacctcccatctctccagcatcaggcccaacagaccaggcagccagctgctgcactgcactcttaacacccgccacctggtgtgtgccaaagacacccatcctgggagctcctcccagacagtggctgtgcacagtggagacactgaggcatggctgctgctgggaagcattggacatccctgatggacaactgtgctctgggaggcaccaatggtcttgctggacttatcttggaagacagagttgttagggaagctccatcaaactcccatgcctctccagtactagtggtgagattgacattctggggtgacagtatctacagccccacctggcctcctgtgcat

SEQ ID NO: 80 - DNA, 5001 bp, Homo sapiens
ttttttgcttccattacttacatctgctttgggacaaatgaaaatgtttcctcttcctataataaacttttctaatccagagatgtcaggggtggccacagaaacataaatgtccagaggctccgaggggaactggtagatgcagaggaagccacagaccccgaaggaaagcagcccatgataaccatctgtacctgccctagagctgcccgttttcagtgggtcctgagtgccccttttagcccagcctcctcccttatcattgcaggaaatctgtgtctgtgttcacactgatgtcttcttacctggtgcctcacatacagtaacacacagctgtgcccgctgctctcagactgttcattagcaaatacagtgagttcttggcattttctttggagatggtgaatttgctcttcaaagattatgcataacatatctgacttccatcacactgtatatctactactcactccagccccttccctggagcctgggaaaccgagttccttcagtagctactgaaggttaatccagagtctgcacaggagagtctcagggatcccccaggttgtcttgggtcctctccggactccacgagctgtacctctcactagacacctgcaaactcgtagacatcctggtcagaaactcccagacataatccaccatttctctcaagggtatccactcacgctcaatctctctagttcaccttttaaaacagcaacagtgaaaacccagctcagcccaagctccatggtgggtcctctgtctttagtcctgatcaccaaatagaaacccctgggaatcccagggctggcgcttctctcccagagctgtgcggtcaggactgggctggttttcatcagcagagggagaaacctatttgcatgtctcctactgtatagcaagctctgggatgggaatcctgaggaggtgcagggctcagagcagacaaagtgccctgggggagattggtagtcatcttatcactcaggaaaatatcattatattatatgattgtgccttgataatcatttagcagtcatcatctttttgacatatttgtagaatacatttaatgcaagtgtcaatgtcacattttaaggaagataaatcacacagagaacagagtgtttatacaatgcattcaaggtcacacagctggacagagttagccccattatctcggcctgtgcctctgaccactagaggagactgctcccctgagacaactccagggcagtgtgagacatgcctagtgaggtctgcaggattccacccctgccaggacatctctgttttcttttagtgtattctgctattgacctgaaatacatagagagaaccagtgttcacgcttgtgtattttcaagagtcagagatgtttcgagtgttcattcccatttagttttggctccacctcaataaatgtattcatttgtttctttgttactgctttatttaaatacaattaataattaattcaaatatatactgcataatttggaaaatggtaacatgtgtgcaaccctttaatcagagcttcaattaatttgtgtacaattcacacctaaatctttgtgtcacttctctgtaatttcatctcaccaccccattactttcaaaacccagttcccaccaatatgtaatcttctctgttgctttagaatagctgtaccttctgcagtttatacaaatagaagtttatgaagtgcactgttaatttgttagctactttcactcagcacagttatttgtgaatgcagccatgattttatgagaatgaggatgcctggattctaatcctgtgttgtactttagttcataatcatacatcaaattgtctaacattcacttgtaatggatatggatacttgagttgttctcttaatttctggctttcatagagagagagcagttactcagtatgggaatgtgaaaaatgaggaaaccatgatcttactctttcctcattaacaacaaacctgaaaaattatgaataaatgaagaagaaaaccttttaacatatctgagttgctttcacggagcaaaaaagaggactgaaatctgaggaggcagacgcctacagagaggactggggcccacatgttaccgaacccagggcaggtgccacggtatggtattgagagaggaacaggctaacctggaaatatttagtgaggattttttttttaattttggatgcatgtgctaatggtgttagatgtgaaactattagtccttgcaggctttttcccggggatctgaaaaatccacagtcagctcccttatctgctgtcctgcggtgctgacaggaagagaagaacggtaaggactgtggaacgcctggattcacctccactgtctccaggggaaatccactaaaacctgtgtcctatggcctgtgatgtggtcatcagaaaccaaagaaaacagaggattcccaggaaactccatccagatgaaatccttaatcttcaggttaagtacaatggaggagaagctgaggacatggcagagaaaccactgtgggttggaaaagacactctacccctgggggaagaggtaagaacaggaaacttgggaaggccaccctgagaatcatgattactgcatatgcataagaaggaggttgttttggaaggttggagaacatccccgtttgttcgaaccccttctccacatggtcaactaggtctgcagaatagtgaagtagctgcatcagctccattctggcctctgtcatgtgacagtttgggtggatttgctttctgctctctcataatttgtttcctctctcaactcctagctccattcttcttttaattctcactttattgaagagattcatatttagcttagaacattaaaacctttggaagtaattttcatctcaaacctaccaaatctaatgagctctctccaggggtgcccatctgctttttttcttccttttctatggggtatggcccttgtttctccctgagtccagctcttattttcatatgcatgaggagtccaaccatcacacacccagggacatcttggagcaacgtaacctatcatccgtctcctcagccctcatgtgcacagtggccactctgtcagctgctgtatgtgctttagggctttccatgtaaaagtgtctctcactttccccccaaataaagttcctggtccttaaataccttcaagagccagtcttctttactgcccctttgttgctaatattgttttattccattaaaatacattgggaacctcagtgactattgtctgacttctattatcccattgtctgacttctgcctgactgacccacccatgagctttaatccactgctctgcagctgatggggccatctggaccttcattcataagaggtgtgtaatttattagagaagacctgagatcagcaggcgcctgagttcctcagaacacaggtgtgtcctgcagtagagtgtgtgtgactgaaatcacacgtgtgtataacttgtagcctcagcccataaggtgatgacaccttctggccattcctggccaacctgatgtggggtgcccacagaaggatgggtacatgacaaggatgttagaaaccgatgtggtgttgggggcatggacggccaaatttaatttaaatctattctgtccttgatacttggggaagactgggagaaagggaacaaaactcagaccctatgtagctcctaatttaggaagggattcagtgcaaattgagaaagttgaaggaatagactatactttaagggatcatttctatagttcgttcgaggaagttgaaggaaaacagttatgttggtgatgttggtgtgttttcctgtgacttacttaggagacagcagaagatgttcagtggtcagtctccatgcagctggtcctcattgtccatttgttatatccacatgaaagataaaagaaaattttgtggtacaggcaccagggctggtttcagagacattgccccaagaatggccaacaggggccaggtgcggtggctcacacttgtaatcccaacactttgggaaaccgaggcaggcagatcatgcagtgaggagatttgagaccaccctaacacagtgaaaccctgtctctgctaaaaatacaaaaaaaaaataggctggcatggtggtggacacctgtagtcccagctgctcaggaggttgaggaaggagaattgcctgaacccaggagacggggtttgtagtcagctgagattgcaccactgcactccagcctggccacagagcgagactccgtcaaaaaaaaatggccaacagggccatgacacatttttatatgagaactactatttctgcctacttcatatggatatctgagagatgtgcccagcctcagggagctgcttctccctccaggagctaacagagttatgtggtattagtctgtctgggtcttcataagaagacaacaggagtgggtggcttaaacaacaaacattgattttctcaccattctgaagtctgaatgtccaaggtccaggtgctggcagggttggttcttggtgcggcttcttcttggcttgcaccttctagtccactatgtctccacatggcctcttctctgcgtgcacgggaaaagtgagaggtctctggtgactcttccacttcttataaagacaacagatctattgcattagaatctcagacttatgatcacatttaaccttaattccatccttaaaattccaatatagatcaattggatttaaggtttcagcatttgaatttcaaagacagcacaattcaactgatgacacaaatcaagagatggtgagaagtattagaatatatattttttttaattaagaaggaaaaatgggacattcaggaacttgtaggaaagttcctagtaattagtgacactttgactgtaagaggaaaatttgccttcctccttcctttcctaccacaaggatgtgaggaagcagaaccacagataataaagaaagaggaggc

SEQ ID NO: 81 - DNA, 5001 bp, Homo sapiens
cctggggacagctgaggtgctggcgaggagggagagcactgagctgatgaggaagccccgccctccctgcacctgctcctgacccggcctcatgctctgtgggccccgcgcgccccctgctggtcctgagcagcacctgcgcccgccccctccgcctccctgcagggaggtttgtgtctgggctcacactcacctcccctcattgtgtctctcgcacagtaatacacggccgtgtccgcggcagtcacagagctcagcttcagggagaactggttcttagacgtgtctactgatatggtaactcgactcttgagggacgggttgtagtaggtgctcccactgtaatagatgtacccaatccactccaggcccttccctgggtgctggcggatccagctccagtagtaaccaccactgctgatggagccaccagagacagtacaggtgagggacagggtctgtgaaggcttcaccagtcctgggcccgactcctgcagctgcacctggggcaggacccctgtgaacagagagacacacagtgagccctgggatcagaggcacctcccatatctccatgtctgcagccttgagacactcacatctgggagctgccaccagcaggaggaagaaccacaggtgtttcatgttcttgcacaggaggtccaggactctcagaaagtatttcccatgtgagcaggaccctgaatttaaggaaatgtgtggtggttttctgtgggtgcctaagtgagatttgcatgtgggtggtgcctctctatggacaggtgaaaagggatgagggaggccccagtcttttagactctccctgggaggaggatgctggctgtgccctctgagaattcagttatcttcctggggcctcaactcactatgtcctggctcctcttttcccaggtgaggaaacagattggaacagcagcttaatgtaacaatcacttgagttcagacacaccaggattcacttaatgttatttttagttcagaacctctatcaggtttagagggaatcgctctgtcccagggagtggatcttacaatagcaaaacggtcttagaaaacccaacataatctacagcgagacctcagcatggcaagcaaggaatcactaaagccaccagggagatccggatgcactgatacgatccagaaacatagcgagtccgggaactgatgcggactttgaggcagcctctttttttttttttttttttttttaaggattctgtggttgaaggtcacaacactgggcctgactgctccctgaaccaagcccagcaccgtgtggttcaccccagtgacattttcagaactttcttcctgtaatgaaagcacggtgtgatgtgtatgcactattgtgtttacctaatgaatgtaaagagaagcacatttcatgcagctgtattttcataaatgtcagacactcatcatgttagtgtctatttttccatgaatctgtactgaacaaattattcattcattgatttgtaatagtcttattgagacattattactatacattaaatattgcaaaaagtgtgtggtttaataagtactcaagccaagccaaacctcctggcacacaacggtagttccagctacttagatggcagatgcaggagtattgttggagaccagaagttagaggctacattgaactatgatcccaccactacactccagcctgggtcacagagaaggaccacatctcttcagaaaaacaaacaaacaaacaaaacaaaatgttattccactcgtgctcacctttgcatccccaaaagccatccaaataatgaacaaacaaattacacttaaaagtttccttgtgttcctctacaattcctccttcccaaatattttcttccccaccatattctgagtcagtccttcatatttaatgctttagttttgagtttcaagaattatacaggaattatatagtatgtgttctatttgtgtggcttctcgcacataactacttatgatgcaaacatgttgagcatcaacaatgtattgattctcatgatggatgttattacagtaaattagcatgccattactttttatctacgtatcttcttgatatttgtatcatttctagtttcttagtattacacatagaggtgcttctcagcttggagatgtaagcaccccataaaaatatgttattattcttacaacagctactaaacttactgatctgcaaattagcacatatacatcaaatttttgatgttataggacaaacaatatatctgaaatctgaagagagataaggacttgcagggaaataaacaggagcagatgataatcttttctggcacagaggctgccaaatgccatttaagttagcacacgattaaagtagacatattcattggatggtttcaatttgagtatgatagagaagttattgtttaaattctcagagtgtatacagttgaggaattcctcctgctattgaagcctttttcttcagtactggggatacatcacaaaatgctccaccctctaccccttgggatggtgctgtctgggaaagcaaaacagcaactataggtgaagtgcatccagacacacctccccatcagcactacattgcaagagaaattatctgcagaggtaaagccatcaaaactgctgttctacagccactggagaaaccaataagaactgggacgggagagaggaatgcaccaagtccctgtccaggcccacctcccgacttcccttaggaataatgccttattcaaaaggaaaaggcagaaactgaagaaatcagtgggaagacatagtggctgctgaaggaacatatgaataaaaatgaagaggccagttgcggtgcctcacgcctgtaatcccagcactttgggaggctgaggtggaaagatcacctgaggtagggagtttgagaccagcctgaccaatatggagaaatgtcatctctgataaaaatacaagattagcggggcatggtgtcacatgcctgtgatcccagctactctggaggctgaggtaggagaatcacctgaacctgggagggggagattgcagtgagctgagatggcaccattgcactccagtctgggcaagaagagggaaactccacctaaaaaaaaaaaaaaagaatgaaaagaaccggccaagtgtagatgaagggccctggaaacctagctacttgctagtcaggaggttgaggtgggaggattctatgagccaggaatttgaaatcaccgtgagctatgttatgatcacaccactgcagtccaacctgcacaacagagtgagactccgtctccaaaaaaaaaaattaattaattaagaactctacacaattgtaaagctactcaaatagaggaagttaaactgtgcatcctcacatatcatcaggcacttctgatattttgaagaagacaggtgacctaagaccttcagaataagctgatgatctcaaatcatgagaagcttccacacaagacattggaccagaatcctcctccatatcctactcattattctttgcttataaacagtcttctcattttctgcagacctggctgttgtccacccatattggagtcttgtctcttttcttactcatcatttgtatacttgctatttagagtaagtcatcagactctgtgtttaggcctgactgctgataacttcaggctcattcctccatcatctctttttttaagcatacaaggtaaatctagttagaaatcacaggagctccctcatttgatgccaatttgaccttgaaaccccacaaaacccttcctgcaagtaggatgctctgccccgctccccaccaagccatgataacaacccagagccagtctccttccctgctctatcaagccactttggaccttaatgagagacctgccctgctctcagcagacaccttaaggatgcaggtaactatcctttccatactcacttggtgtgagtgtgtggcataatcacactcaacatccacagaaaattttagtcgagatctcttggcattggcatggtgtcggctacaatggatgctgggagcttggtgtcattgctccttccaaaggacatgcctgctccctgagttaactcccagacgcagttggacaggcctcctggggtctgagaagctcctttcatgtactgaaatcctgtcattatgtttttgtattctagtgtctccctaaaagtacagtgagacccagggtccattcatgtgtgtattcaggactctctgaattttatgtattttattcatctctctctactaccttttctaccaaattagatattttaaaatttgcaatattttaatgaggtgaaattagcaaataagaacctttacataaagtgtacaattttacaaatagtgacataatcctcacttttactaacagagaaaaaattatcctagaaatttccttttgctctcctgtcgtttctcctttctataccttctcttcttgtaccatgtccccagtcaactacagatctttttatgtaactttaagttcatttttactttatagaaattatagaagtggaatcatatgtatgcacttttatttgtttgacttattttacttattcaggtacttgttattttaagcatggtactgagtgtatccagcagtacttcattgtaacagtgggtattattccagtaaatgaattttccacaatttgtttaccagttaagctgctgaataacagctgaatcgcttttggtctctgggtataataaacaaagatgctacttagcttagagaagtaacaagctgagaaacacacgggtcttatttttacataacatgaatagcaggcaaagcagaaaagctgcacactaatcaatttgcttcaatacatcagataattgaagttgggaagctctgtgtgtgtcagttcatgtgtttttgtgcgacagagagaagggaggaggagagaccatgccaaaatgagaccctacctgttttgaccata

SEQ ID NO: 82 - DNA, 5001 bp, Homo sapiens
atcacccccagatcccagccgtggccccagccaacccatggaggtggggcatggcacagcaggtgctgcacaggagcccaagcacaagggcacttaggagaaggaatctgagcagggatcgatctggcctgggggtgattctccagaaactccattcctcggggctgtgaccaccaagccaggtgatcaggccagtgatgtttccctttgggccaggtcggggagccagacctgggagggagactcctctggggcccaggggaggtgagtcagagctggcagaggcctctggctccaggaacctccaaggaggagacctgagttgctgggaatttctgggtctgacctcctgccaagtcaaggtctgggctggacacaaggtgaggctgtgccttctggtgccaggaccaaggaaatgctgggatctgggcagtgctcagaggcagcaccgtatggcagaaccatgagggtgcaccagcacggacccctttctgcaacccacccatccctccctgcagcacctcgcctcctccaggcaagaatctgagccttgaccacagctccctctctcacacagcttccttctttggttagaaccacctggaggtgactgtggccatggctctgactgacatagacctgcagctgcagttctccatgtcccaacccgaagccctccttctcctggcagcaggcccagctgaccacctcctgctgcagctctactctggacacctgcaggtgagtgacgtccccctgggattggggcgagattccttgtctagctttgagtgaaccccagctggctgttgaccttgtgtaagtcacttttcttggggtctcaagttctccactgtgggatgggcagcagcagctcagaaatggtaaatccttcatgaactggctctgcccaccggctccttccaaccatgtttcccaccacaagccctcactggccctttgtgctctgactacactgaactgctttcagttcctggccatcttatggtcacttgcagccaggcctttggtcatcacactcctcctgccaggtgtgtgacccacccattccctgtacctgccgaactctagtctctccttgaagtttcagtgtgggcatcccctcctcctcggcgagaccccctcctgggcccccatgacccctgcgcatcctggtggcactgcaccaatttatctgcagcaccactgtctgtccatgagagtaacagcaccagtactgcctcagcttcatttttccatttcatccttcaagacaccacaagctttattatcaaggagtcttgtggctcctacttgagtcttaccccataccaggaagagtttaagaacccagggtcttagtccaaatttggggcaggctgggtgcagtggcttatgcctataatcccaccactttgggagaccaaggtggaaagatcacttgagcctaggagttcaagactggcctgagccacacaatgagaccccatctctattttagaaggaaaaaaaaaaacaaattaacaaatttggggcagccatctctttccacaccccagtgggaagaggactagggcttggtcagtctgctgctgtcattgctgctcattgccacaaggtgtcactgttgaacacctatgtggtgcagtctggtgctgatggctgctgagctgtgcaggtagtgatgccacatccctacagagatgcaccataccaggactccaagatcatggttcttagtgttctggttctgcagttcccatactctgccatcacctattctagcatctgggagcaccataccagagccatttcttgtgtcaatgtcatggtgacagaactatgtccttcatctctccttgagatattcctccaccacaggtcaggcagctttttttttttttttttttccagaacacagagcatctgcctgggctccctgtccctgaacagttagcctggcttccttcagtgacctcgagaaactttgccaaacttagggggactgatcaacggattctcagttacccattattccaggggtgaaatctagattccaagacaatatttctggtgcttctcactcaaggaaagaggaggagaatttaaaaatacaggttgggtttctagaagagcatcttgctatatgtcagttccttgtgggcaaggaccacatctgattcacaccagggtccccagagcccatccaggcctggcccagagtttcctttggtgagtgtttggaggatgaataaagagatggcaggaaggcaagaggagtggcaccagaggcccttgtcctaggttttctgctctggggccccctgtggggaacccactgtgcttttataagggaaatgatggattcaaagtgctgccccccatctcccattccccgtctctcctcaggtcaggcttgtcctgggccaggaggagctgaggctgcagaccccagcagaaattctactgagtgactccgtcccccacaccacagttctgactgtctcagaggactggcccacattgtcagtcaatgggtttctgaatgcctcctctgtagtcctgggagcccccctagaagtcccctatgggctctttgttgggagcactgggagacttggcctgccctacctgaggggaaccagccatcccctgaggggttgcctccatgcagccgctctcaatggccgcagactcctccagcctctgacccccaataagcatgagggctgtgctgaagagttttctgccaatgacgatgtggccctgggcttctctgggtcccactctctggctgccttgcctgcctggggcactcaggatgaaggaaccctggagtttacactcaccacacagagctggcaggcacccttggccttccaggcagcaggctggcatggggacttcatccatgtggacatatttgagggccacctgtggtccatggttgagaagggccagggtactgtattgctcctcaacagtgtgcctgtgactgacgcacagccccacaaggtcagcatccacatcaacattcaccagctagaaatctccatggaccagtaccccacatgtactttgaaccgaggagtcctcagctacctggagccacgtgacagtctccttcttggggagctggtgcagaggcctctcgtcacctccaggaacaccgctcaggcctgacaccaggggctgccaatgcctccctgctgggctggctgcatggaagacctcagtgtcaatggctagaggcaggggctgtgggaagccttgctgacgcacaacatggtggctggctgcagactggaggaggtggaggagtatgaggacaatgcctatggccattatgaagctttctccaccctggctcccgaggcttggctgtccgtggagctagctgagccatgcgtgcctgagccagggctacctcctgtctttgccaatttcatccagctgctatcagtgcagtggtggtgaccgagggtggcacagcctggcttgagtggtggcatgtgcagcccatgctggcactgatggaggctgaactgcgtaaatcccaggtgctgttcagcgtgacctgaggggcacactacagcgagctcgagctggatgtcctgggtgcccaggcatgaaaaatgttcacccttctggacgtggtgaactgcaaggcccacttcatccacgatggccctgaggacacctctgaccagctggtgctggaggtgtcagtgatggcttgggtgcctatgccctcatgcctgcggaggggccaaacagacctcctgcccatccaggtcaaccctgtcaatgacccaccccacatcatcttcccacatggcagccttatggtgatcctggaacacacacacaagcctctggggcctgaggttctccaggcctatgacctggactctacctgtgagggcctcaccttccagctccttggcaccccctctggcctccccgtggagcaccgagaccagcctggggagccggtgactgagttctcctgctgggagttggaggccggcagcctagtctatgtccactgcggtggccctacacaggacttgacattccgggtcagcaatggactgcaggccagccccccggccatgctgaaggtggtggctgtccagctggccatacaaatccaccgcagcacagggctgcatctggcccagggctctgccatgcccatcttgcctaccaacctgttggtggagaccagcgccgtggggcaggatgtgaccgtgctgttccatgtcaccggaggcctgccgttcagggagctgcagaagcagggggctggtggggtggaggatgctgagtggtgggtcacacaggcgttccaccagcaggatgtggagcagggccacgtgagatacctgagcactgacccacagcactacaccgaggacaccgtggagaacctggatctgcaggtgcaggtgagctgggaaatcctgagcaatctgtccttcctagtgaccatccagagagccactgtgtggatgctgcagctggagccactgcacactcagaacacccagcaggaggccctcaccacagcccacctggaggccaccctggaggaggcaggcccaagccccccaaccttccactgtgaggtggttcaggctcccaggaaaggcaaccttcaactacagggcacgatgatgtcagacggtcagggcttcacccaggatgacgtacaggctgcagaggtgacctatggggccatggcacgtgcctcagtggcagtggaggacaccttctgtttccatgtcacagctccaccatatttctccccactctgtaccttctccatccatattggcggtgacccagacatgcctgtcctcatggtgcccgagggtggtgagtgtgtcctctctgctgaccagctcttcatcaagagtctcaacagtgccaggtacctctatgaggtcatggagcagccccgccatgggaggttgacttggcgtgggacacaggaca

SEQ ID NO: 83 - DNA, 5001 bp, Homo sapiens
aagatcactatggtgacatccttcaccaatggagacctgatgcatggccagctggtctagcagcatgatgactccgagatcacagaagatgatatcccatttcctgctgccaccaggaccagagcagtggtgacgtggcctgggaggaggtatggggtgtcttctgagtggccatccagcctgtgaatgaccacgcccctatgcagaccatcagctgcgtcttccatgtggcctggggtaggtggcggctgctgactacagacaacatggccttcagcaatgctgattcgggctttgctgaggcccagctggtgctgacccaccaggacctcctctctggcagtatcatggccacggatgagcccatgcagcccatctgccgcttcatccaggaggggcctcaggaagaggcgagtcctgttcacacactcaggctgaccacggctggatcccgctgcaggtgtccgatgggcagcaccaggccatcacggtgctggaggtgcaggccttggagccttacctctgtgtggccaatggctccggcctcatggttcctcaaggaggccagggtaccatcaacatggccgagctccacctgggcaccaacctcaacatctgcagtagggatgaggcccactaccacgtcacagacagccctcactggggacagttgctccaagccactcagccagccacagccttctctcagcaggacctgctggttggggctgttccctatggccacaatggcagcctcagctcctgcaacaccctggccttctcaatggatgtgggaccagtgcacacagatgccaccctacaagtgaccattgccctagagggcccagtagccccactgaagctggcccagcacaagaagatctacatcttccagggagaggcagctgagatcagaagggaccagctggaggtgaggagctggaggtggtgagcggggtgtggaccaggtagagggccttcctcccagcctccatgccgggaacacatgtgacttgggctgtacctgtggtggtcccagcttgcgtgtgtgcacgtgcctcagatatgctcccatatatgttgtgttcccaagagtttctggggagcttgctgtacacccatcctcctgggagtggtgtgtgcctctagagctggtgcccactcatgtccatggcatggctgagcatgcagattcctggacgccacccagccctacagaatctctgaagtggagcccgagaatctgcattgcagtcagttccctgggagggcatcacgggtcctgaacttttgggattgctggccgtggagacaggccgctgcctctcagacccctgtgtagcctgctctcttctcagagcccagaccaggaccaggagggtctgtcaagggcttctgcttacccaggaacctcacagagcagccacgggccttccagagatctgacatgccctgtgacctcaggccagtccttgcccgctctcagccttactcttccacactgcttatttcggagacccttctggtctgcatctggagcttggggcccatggtgagccagcagatctggcatcaggaaggcctcatgggaggaggcagtgtttgggccgggctctgaagagtacaggccattaggagcagagaatggggagtggtattccatgcaaaaggaacattccggccgaaggcacaaaacaggaatgtgagtttggaggcagtttagcctcttgtggatggcccatcaggtgagggagcccatgtggcctttggggtgtgagctctgtagggcctgtgctgggggtgcctgtgcctctaggaggggtggggtggggtggggcagggcaccctctgatggtcctgggtggtaatagcaggggttggggaggatgctgccagcaaaccagccacaggcctgaacagatcctgagcagggggcctgtgtgcgtgtgcacacacgcatgtgtacctgtacctgtgtgactgcatcggcatctgatgaactcatatgtctgtgtcactgagtctggggacatgtgattatgcacttccctgagggagtgcatctcaagctgtgtgaccgacaccccgtaaccatgtgtggggtgggtattaacatgtgaccagctggggcaacccagtgaaaccccatctctacacaaaacatttaaaaattagccaggcatggtggcacatgactgtggtcccagctacttgggaggctgagcccttgagcctaggacgttgaggctgcagggagctgtgatcacaccacagcactccagcctgggtgacagagtgagaccctgtctcaaaaaaacaaaaaatatgaccagctgcatgtctggctgctgtgtgtgtgaacccacatgtgtgtgtgtcactaaatgagcagtggtatctggggaaataagtggagcaagatcaaggctgttctggctgcttagggccacagtgggcccctctgagacccctctgcgcattcccttgtgagtcctcatgacctctgttaaccaggtagcccaggaggcagtgccgccagcagacatcgttttctcagtgaagagcccaccgagtgccggctacctggtgatggtgctgcgtggcatcttggcagatgagccacccagcctggaccccgtgcagagcttctcccaagaggcagtggacacaggcaggatcctctacctgcactcccgccctgaggcccggagccatgccttctcgctggatgtggcctcggcctgggtgctccccttgaggacgtcacgtggagctggaggtgctgcctgctgtcatccccactgggggcacaaaacttcagcagtagagggggcacagtcgcagctgcaccctggcccctccactgctccgcgttgccaggtcctacttccccactctcccgggccttggcctgcaggtgctggagccaccccggcatggggccctgcagaaggaggatgggcctcaagccaggaccctcagcaccttctgctggagagaggtacggctgtgagagaggcccaggggctgcagcccagctctgggggcagagtggagggagccccggggactcccagtccaggggttatacagagaggagacagggagtcacatttcagaaagacctatgctttagatgctgtatctcgggctgggcgctgtggctcatgcctgtaattccaggactttgggaggccgaggtgggcagatcaggaggtcaggagatcaagaccatcctggctaacacggtgaaaccctgtttctactaaaaatacaaaaaattagccgggtgtggtggcccgcacctgtagtcccagctactcaggaggctgaggcaggagaatcgcttgaatctgggaggcagaggttgcagtgagccgagatcacaccactgcactccagcctgggcaacagagcgagagactctgtctcaaaataaaataaaatatcccctttcttcctcacaactcctctgggaaccagaacttatggtccccattttccaccaatggaagctgaggccctaaaagggtcagtctcttcctgcacccaaaggcagaacatgaagggtgctgctggggtctgactgccagccctgggcctgcccctaggtggaagagcatctgatccagtacctgcacgatgggagcaagacactgacggttttgtcctgatggctaatgcctctgagatggaccgccagagccatcctgtggccttcactgtcaccatcctgcctgtcaatggccaacccccgacctcatacaaactcaggcctgcaggtgagcatattcctgggaccacccccaatgtctgctttgagaaagaggccaatgtcccctacttcccggcacagatctccccccctctgagcctcagtttcctcctctgcaaaatgaggacactactgtgtgcctcacgcagttgttggaaggagagatgtgagattgtgctgaaatagaacacaggcgggaggttttgttattggacatttgcaagtacggcaggcagacttctgagcagccatgggtggctctgctgttccttctcctgtggcttaggaccagaacacctgaaagaatcacttacaagcccttaagggctggcgtcagggtgggaccgttaagcttcccaccttcaccccagcaagtgaaggcctcagcttggcttcccaaactcctgccccttgtccacagcagagcagggcccccatttggcaaaggtggaagttgaggcccagacatgggatggaacttctccatgattgcaaaagtagttctggtggaacagaaagggcatggctttactaagcccaagtggcagggctttgaaccccagcttctggggcgcgtcctccccagtcagcagaagccactgaaggttccgcaagagggctgacttgggctgtctctgacatggggcaccggggggctttggtggtctaggatgtgcctgtagggggtggcctcatggtgcggaggccacagaagagtgggacacagcaccctggaaccacaggctgggatggctctgtggcagtgcggccaccaggtggtgccatctacccgtgtttgttccgggagcccagtgatggggccctgcctcccacagtatggcccctcttgccaaggctcggcctgagggctccctgcggccaggggaggaagcccaggaatgccagagggctgttttctgggcatgtgagtcccactgcagcactgcccacaagtaattgacccagcaagactggtaccaggacctcaggaacgggtgcctgttctgcttgctagtgggaggcctgaaaaggggccccctttgcccaacacgaggagggcccgtaactgctctggaagcacctgggcccatcccagcactgcttctgtgctgcaggacagtgccaaccatcaggcttcagctctctgcgcctcccacccctcccttagctggaaggagtgctcgtttctaaaatcactgttcccacctgtgcccagcccctgccag

SEQ ID NO: 84 - DNA, 5001 bp, Homo sapiens
ggcacacatggagggtctgaaaggagactgctgccccaccagtgagacagattaaggagcactgttggtcagcgctgggggtttctgggggtgagaacttggtgagggtaagagctagggccttcctgggttgggtacacaagctggtcttgagggacacacaggactaggacagatgaagagcagggatgctgggcctggagggtggccttccctggggtgacagggaaggtgaatgcagggaggccatttgtgcaggggagccacagcagcgccagccttgatgccacctgagggcctgagcctcagtggggttggagccctggtggcagcccagggccggggaggaaggggtgggtaagtgtggcagggcagaaccttcacaggcctgtgtccccagacgtgggagggggccaccgtgcccatccctacagaggctctgaggagcatggatggttactctgggcccaaggacctggtgtacaccattaagcagcccagcaatgggtgggtagtgcggtgggcggtgccgggcactgaggtgcgcagcttcatgcagacccagctggatggtgggctcgtgctgttctcacacagaggtgggtgctgagggccgagccccaggtttctgctgcccacgggggcaccctgaggtggggagccagttcaggccagctggacccaacacccttgtccccaggggccctggacagaggcatccactttggcctctctgacggtgaacatacttcctccagacacttagcttctgagtgacggcccagaagcaagtgcttcactcgctggagggcagccagacactgactgcccaggtgggtgtgctgattgtgggcattcctgggtgcagggggctggggcagagctgagggtggcatgccagggtcacactgcctctctgcagccacaggcctcggcctggatcacaaaggctgatggccccttttgcctctggcagagtccgtccagccactcagcagccagagcctcagagccagcaggcaccgacccccagctcctgctctaccatgtggtgcggggcctccagctaggccggctcttccacgcccagcatgacagcacaggggaggacctggtgaacttcactcaggcagaggtaagggccccactctgcagccaccactcagatgcgcccagcctcaggtggccactgtgccatggacatcatgtggacatgggcaccagctccagcatcaccggcagcagacactcccaggcctgccatggtccaggacctggtgtcctgccctctaggcgtcatcaggctggcagggcaagttcatgttcccagaaggagggagaagaatgcaggaagtcggggatacagggccctagagcagggctggggtcttggggtgtggcttcccaaaggaagctagagctggacccaagggtctggagagggagaaccatgtaggggcactagtggcaccccagtagctggtgaggggcagtgcttggtgggggatggagtcggaggtgaagcagctgctggggcctgtgggcagaggtgtgagcctcgggctcagatcaggtgccagccagaggaagagtggatcctaggagcagatgagctgatgaaaggcagctgagtcggccaaaagggggaagccactgttcatctgtcctggtggcttcagagaagaactagagctctcagccatgggtagtggcagactctctgtggtaattgtgccatgggggccagcccagtcatggtttaaatgaacacctctccccaaaggcagaatgggagttgttccatagcagggcagggcagggcagactcttgtgggccgtcctgggcaggcagcacacctgatgcccccatcaggaggctgcgtgagcatctggacccagcacatgatcacagtgagttctgggcagggagcggtcttgtggggcgcagagctgactctgtcactcaggagccacggcccgcagcactgccccaagtacctccagaggggacccctgtcagcccttgaaaatggcagagcccaccccagcccccttttcaagctcccttgcttcggcaaggacctcctgagcctggcgctctccctcctgagaggtgcagatggtactcagcaagtgcaaagccgaggtttcttgggcctctcacatcagcacctcccagacctcggttctgtatttccctggagctccactcctgctatggtgcccttcccacaatgagatattcatcaggttggtgtctacagctgctgcgtaccctcacttgctgggagcctttgtcaagaatgcccaggaatgaggagggcacaggacgcagaccatcagcaaccctcttgcactctatagtcccatgttactcagagcttccccatgctccagcaagatgaaggactagattgaatgggcaccaagctgacagtgccacccaggaaagccgggaagaggctacatgggctacctggcccactcagggaggagggcaggactgggtattgtcttgacagcaaccctgtcccacaacactgaactgggtagggaaggggtcaggtgtcctcatttttcagataagaaaactgaagctcccagagggcaggtaaatgtattcagagcacatggcaagtaagaggcaaaacttctgccagcaagtccaggatttttttcaccagaggacattgcttggtccccagacctcaggaccctgtgttttgcctcactcccacccacagagctcctgtatccaggtatcaactccaactcccactcctggaggccgaggcaggaggatcacttgagcccaggagttcgagaccagcctgggccacatagtgagaccttgtctccacacaaaaattttaaaaatagctgggcttggtggtggcatgtgcctgtagtcctagctactcgagaggctgacgttggaggatcactttgagcccaggaggtggaggctgcagtgagcagtcatcactgtactccagcctggtgacagagcgagaccctatcaccgccccccgccccaccaaaaaaaaactgagtagacaggtgtcctcttggcatgataggtcttaagtcccctcccagatctgtgacatttgacaggtgtcttttcctctggacctcggtgtccccatctgagtgagaaaaggcagtggggaggtggatcttccagtcgaagcggtatagaagcccgtgtgaaaagccatactccaaggggctccaagtccagcgcacagtcccagaagggcccagcaaggcagccagggcggcacaggcaccaggtcccaaccttcttccctgtttgcccactctcagaccccggagttcatcatctcggagccgctggccaatatgtactcatgtgggaaccagaacacactgatggaggagttggcagagcaggcacagcagcacgacgagatgctgcacatgcaccacgcgctgaaggaggcgctcagcatcatcggtgacatcaacaggaccactgttaccatgcccccgcccgtggacgacacctggttgcaggtgcagagcatccctgacgcacacaggtaccagagactgccccccacggccccaaaatcccccacccgggatgcccagaggagtgccctggggacaagtggcacaccccctcaccggggtggctcccacctggagtgacggggggagcttgacaaggagcactggctgcgggggggggggggggaggggtgggatgttctcgctgctgggggcggggcttaagctccggcaaccgccttggggtgtggcagggaggagcttcagtgcatgggtgtggccggcactgcgctggggcggggccgcccatctctcccctccctgtgcctcccaggtcgcccaagtccagcgccaggatgcccaggccctgccatgtccctagcccggcctgggtggcagggcccagctcctgggcggcaggacccagctcctgggcttcctcctgctgggtccgcccttggggaagtgtgccccataccctccaggccagaggcttcccctgatccctttgggccctacccccctggtgctcttgtgccccagccggggtccccaggtaagtaggggctgaatgcagccaaagaggccgctggacaggcgtggccaggaaggaaatgggactggattccagagcaccacatctggccgccagaactggccgtctccatccaaggcactgggaccatgggtgccggagccacgtgtggccgagggctggcagagcctgccccccagggatcactgagtcctggaggtggtcgtttttgaggagggggctgtggggctcgtcccacctgccgccttctgtccagcacttgcatgacacttccctctattttcactcttggcggctgcccacactttgcatttctcttcctttcttctcgctgtcctccatcctccattccgtccaactcctagcccagtcccgggggcgcctacttcaggtctgagagtctgaactccgagatgctctgggtgtgtggatttccttcagctaccctgatgtccccacttccaagtcctgactcctttgagccatcccagggggtgtccggccactggaccacaggagcagaggcgagtctgtgactgtgtgaccagcaaggtgtgtgatgtgtgcgtgagcgagcacacgagtgtaaagaatggcacccagacctgagctaggacagagggagcctgggggccacaggcaagctcatttcttctccacacccctccccgcccgaccctgtctaaactaatggggtagtggtagccgcaagggcagggatgggagtggctgaagcctacttcactcccaaagatttctaaggaaaatggttctactgcatcctttggctgggccttgttgacccgtgaccctctttcaagaacattcactctgatttccagtgtgccgtctccactggccacgttctctaaggaagaacaatagcatctgtttttgtttccaaatgg

SEQ ID NO: 85 - DNA, 5001 bp, Homo sapiens
gggggcttgccctttaccaaagactggggaacagtcagtatcaatcaatagcacccatcaaagtcagggagcaggggtggctgattacaggacgggggaaagcctctctaaaccatcttttggggaccccattgtctcttcccaggactaggcattggggtcctgctctactggggtcctctttctctatgtagaagcctctctcgaagctgttcatggaaacagaagataataaccccattagcttctgaaaacctgctattctaagaaggcagctgtccaacctaatttaagatggggcttctcctacattctcttgcactttaagaagccagtttctcagcacccttggggaagggagagccttcccagaagtggctgggaagcagaggaagtgctgagccctagggcgagggagggtgggtcattcttacatcagtgaatgttgaagagaaggccctgacccaccccgttctgcctgccagctctggggtgtggctctgaactcccttttccctctaaagtaaatggaaaggtggcaattcacagttgtgtgtgtgtgtgtgtgtgtgtgtgtgtgtgtgtgtgtgcgagagagagagagagagagagagagagagagagagacagacagacagacagagagagagagagacagagagagagagagagagagagagatgcaaaaggcatcagtgacctggcctagaggggcccctttctgggagtaccactgagttttatcactgtgtgaaatgccagcaagctgcaaatgaagaataactttcaacatgtcctttcagtgtaaattacccccaaaagcattatgttacacctttgcagggtggctgctggctgccctgtggagatgcctttgccagttgttggccctcacacccagaggtggaaaatacacaagacttgaaatgggtttgtctaggctgcttagggggtgggaggaattccctaagtggagaaaacaaacagacctaacgaaagcagatcaaaacccagcttaccacacattgttccgcacctgggggcagaaaaaaaatcagagctctaacaaagcagggaagtgagaggtggtgttgggatgctggaaaaatttagtatacctattatagcacgtggctgggtgcctctactctctccagaaagggaaaggtaatgcacccagcagaggaagcctctgtagtttggagagggatgactggctcccaacatggcaggcagtagcacaccagtgtctcctcaccagcactctcacttccctgggagtttgggattagagaactgttctgttcctttcagggtcctgtcccaggcacaggaactaggtaagtagaaggaagtgaaagctttcctcctccccggtgccctagatcctcctgtccaactaccgtttgaaagtttggggacctggggcaggagcagtggctcatgcctgtaatcccagcactttgggaggccgaggcaggagaattgcttgagttcaggagttcaagaccagcctcagcgacatagcaagaccttgtctctataaaaaaataaaaataaattatccaggtgtggtggtgtgtgcctgtagtctcagctactagggaggctgaggcaggaagcatcactcgggagatcaaggctgtagtgagctatgctcatcctactgcactccagcctaggtgacagagtgagactctgtatcaaaataaataaataaataaataataaaagggggcaggtgcagtggcttatgcctataacaccagcactttgggaggccgaggtgggcagatcacaaggtcaggagtttaagaccggcctggccaatatggtgaaaccccgtctctactaaaaatacaaaaattagccgggtgtggtggcgggtgcctgtagtcccagctactggggaggctgaggcaggagaatcacttgaactgggaggcagaggttgcagtgagccaagatcacgtcactgcactccatcccgggtgacagcgagactccgtctcaaaaaaaaaaaaaaaaagttcgggggacctgagaattttttcacaaagtatgagttccgcgaagctttgcttcagctccactagcctctttttttttttttttttttttttttgagatggagtctcgctctgtcatccaggctagagtgcagtggcgtgatcttggctcactgcaatctccacctcctaggttcaagcaattctcctgcctcagcctcctgagtagctgggattataggcatgcgccaccacacccggctaatttttgtatttttagaagagacggggtttcacctgttggccaggctggtctcaaactcctgacctcaagtgatctgcccacctcggcctcccaaagtgctgggattataggtgtgagccactgcaccccgcccactagcctcctttctattcctggaagctgccttcctgcctcagggcctttgtacctgctgttctccttaccaggctcttggagaggctccaccttcagctaaagttcctttctcaaagaagcatcccctgcccactgcttctaaaataggattcccacctccaaccccacaacaactgtcatctctaggagctgaaacataataaggtccagtgagcagggatctctgtcaggctttgctcattgatgtgtctccaatatctagcacagtacctggcccattgttgatgctcactacagcttatttgaatgaatgttggatgaatgaatgaatgaatgaatagccataaccattattgctattgtcagggctcagaaagtgatacccccaaaatatggcactttggcatgctgagtgctttgaattaaaggagactggaaggcctcagaggcaaagtctgtctgactttctcctgccctcctgtcttccactcctttttctcccctgaagtggagaatttctcttcccgatggcagctcatagaagctagaacccctctctcccaaagtaagacataaaacttagaaaggtcactctcttccttctccctggaaaaccctcattccagaggggtcctgtctcatacgaattggggagggaagggggaaggaatgctacacagagaggccaggaagaatctgaatggatggatcttgctgggttttctccctcagtctattgccattagatcatactcttttctttctttctttcttttttgagaaagtgtctcactttattgcccaggttagagtgcagtgacacaatcatggctcgctacagcctcaacttcccggacttaagcaatcctcccacctaagccccctgagtagttgggactacaggcacacaccaccatgcttagctaattaattgttttttttgtttttttgtttttgtagagaccagagtctcactatgttgcccaggctggtcttgaattcctgggcttaagcaatccccctgcctcagcctcccagaatactgggattacagacatgagctactactcctggctagatcatatccttttgtgcaatcacttctacatggctatccattcttcatagaatcttaagtgtcaaaatagttttccctgggtctattggtcattatttctgaaggcaaccatatcatgtaaaactttgattaaattcatctgctatccttttctcttgttaatctgtcttttgttttgagtgtcagccatggcccttatgatagaagatgaggaaaggtatcacacctttccgccccatactatcaaacaccatcctgtttacttattgatttgtggccagattgaaagctctatgagagcagagatatttctgtcttgttttccaatgcttatcatcagtgcctgcaagaagagtgcctgaaacataaaaaattctcagtgtttgttgaatgtatggtcctgttcagggaccatgtttgtcacagacagatgtgtccagattaaagagaatatcctctttagaaaaaaggaagaaaatgctgatgcacagatagattgggttgtggtagagctattcccattaatccagaatcattttctatactacagcatggatttacggtttctttggctaaattttttttttttaaaagcttatatatgtttgggaatagacgaagttccagataatggatttttctgtttaaaggagggctaacaaaaatctctttttttagaccaggcccagtggctcacgcccataatcccaacactttgggactctgaggcaggtggatcacctgaggtcaggagttcgagaccagcctggccaacgtggcaaaatcccatctgtactaaaaatacaaaaattagctgggtgtggtggcaggcacctgtaatcgcaactagttgggaggctgaggcaggagaatctcttgaactcaggaggcagaggttgcagtgagccgagatgacgccattgcactccagcctgggcaacaagagcaaaactccatcaaacaacaacaacaacaaaaaacaacaacaacaaaaaaccctctttttttagaatgcttcttgtaaatttttatttatttttattttttatttttttgagacagcatcttgctgtcacccaggctggagtgcagtggtgcaatcagggcttactgcatgcagcttcgacctcccaagctcaagtgatcctctcagctcaacctcctgagtagctgggactacatatctggctaattagaatttttttttttttggtaaagatgaggttttttttattattatacttcaagttttagggtacatgtgcacaatgtgcaggtttgttacatatgtatacatctgccatattggtgtgctgcatccattaactcgtcatttacattaggtatatctcctaatgctctccctccccactcccccaaccccacaacaggccccagtgtgtgatgttccccttcctgtgtccatgtgttctcattgttcaattcccacctatgagtgagaacatgtggtgtttggttttttgtccttgcgatagtttgctgagaatgatggt

SEQ ID NO: 86 - DNA, 5001 bp, Homo sapiens
gtggccaacaatttttgtaaaagatggctactctgtagtgctttaactggacctatttagacaatgccttacacactggaggacgatactgtgtaaatctaataagtctacaagacaatacttctgtcttttggctctctccttcctctccagggtgatgacaaatccgtgagggtggagattatacctctctcatcatttcagcaccaaggaaataaattagtggcagagtaagggtgacttgatgagtacatccaattgttgacatagttttgggtggagaaattttgctattatatcgacttcttaaaatagtctagtgggattaacttggtttcaattcacagagatctggaagcgaggatcttttaaaaatcctgaaatatacactgcaataaaagaacaaagcatacacctcagccttaaatgactgaagaagtatgtcaagtagcagcaggtgggaaagtggctttggttttcagtttgtgagctctgaatccacacaaaaacaggactgcattctgaaaacctgaattaattattgtccttaccacaatgaggcagaaaagtataatcaaaatcattagtatttcagtcacaattaatgccaagatgagtttgtcagtatagccgtatcctggaacttcttttgtgagctaaaaaaaacaaaaaaacaaaaaaaaaacacaccagaatgagagctaactattcaaaaccccagtattccaggtgagtagcttacaggttctattttatttttttgaaagagggtctcactctgttacccaggctggggtacagtggtgcaatcaccgttcactagactcgacctccctgggctcaggtgatcctcccacctcagcctcccaagtagctgggactacaggcacgtgtcatcaacccagctaatttttttattttttgtggagacaggctttcactatgttggccaagctggtctcaaactcctgacttcaagtaatccacccaccttggcctcccaaagtgctgagattacaggcatgagctaccacccccggcctacagttcatcttgtgccctaatctatatttcactctctacatgagcaaagtgggagatcactgtcatgaccaaagttacatggccaagataagctatggcctgggagtcccagattcttctgtgtgggcactttcctgggatatgctaaatgatgggaaatctgggtctcatgtttctgtgtggtcctcacctcaagcgacttctctttctgttcactctgggcttccgtgctctcattaatgtagttctcagtcttccattggtccgtatcccattctatctcagatgcctttacttcctgctgcccactgagaagcttcatcaggtggcctgtcctggagatgagcttggcacaggtcacttgcacatgggccccagagcagtccatcttcaaggtccggataacatgagaaatgagccttctcacattgttgttggggataagggactgtagctgctgggttagctgaatttcaaactgagcaatgggtaattgaagcttttgggctcgggggacaggtcagtgcccacgttgttgtattcccattttgtctcagtttgtttaacagttggccctaagttgaatgcagtcccagcggaatctgcctcaggaggatgattgtagtttgtgttttcagagatggtgacttctggcatgttagtgttttccataaaaacattttcttccaaggcatttcttgcagttgtgtcttttatattagtggtttctataaaatgttctgaaggagcagatacttccagaaaagggttttcttgaggactcaggtctcctaaggatgaaaaagccccttgtgaaggggaatttatgaggctcttcgctgcagagaacggaggcctgtttgcgagcatcagtctactcagataacttttctttctgaactttggactctttttgaccttgggtgttctgtgggtcatgcggagcgagttttgtgaaagcggtatttttttctggaatgtgaaattggtttagaagccttcatatttgtaactctagcctttgcactttctaaaatggaaatagtgtgtgttgtctttcaatctgtctctcacctgtggtagggcttttgcagggctggaggtagaaggcgcgcccttggagaagggtgtcagcacagagactgctgccttatgctcttggctgaacgaaggcttggtgtagatggcgtttcccgctaacttctcaggcccctgctgtgtgtgaggctgttccagctcccttggggctggactcccgagccttttttcttcggcagcgttctccacagatgcctgggcaccctgttccctcctgatgctctgccttcccacctctttgaagtgccttttctggatgctcattgggcccatgaggactctattcactttttgccagttttggcctacagtttgaatctttgccaggctgtttcctgtggttggcagtttaatgaacggtagtaacattgattccacatctaggtttactgctgagaaatatggcaaatgtaacttagtgcactgataacatcactctcgtcattggtgtctagctgctcactcccaaagcctgacaagttgatgccactgctgtctgagggctcctccggctcaacagtcagctcagtgcttgtgtaattcttccgggcttgtaacatcttcatgaatgctccttctggattccctacagattcttcttcagctgtcaaaaaagagactgctttgctcgtgaaagatgatgggatgggatgcatcagtccatagctgtacaccccagtcacgcagagtaggagtcagcaaacatttgagtgccattcagagaggagacacacacacccaatcctaaacctatgaaatggcaacaacaaaaggagaaaatatatcttttgaaaacacggccatctacttggaacattccatagtgtgacatagagtaactctgcttaggattatttcattgatccccagggtccaattgcccagtgctcagtcaaagcccaaggtggaagacaagtgcttccctgatgagctgatgagctggcctctctgcagactgctccataccctgtgctgtcctgcctcagatgcagagagagcacaaggctcccgctctcctcgtcctcggtgcgcctgtgttcttgctaccatcacagctgaatgcaatgaaaggcggtcctctgagaggagcagggtggagatgctaaagtggaggccccctcccattgctgatagatcctcatctggcatgcgctccaccctccccattctctgctcccacatatcgtagccccatcacagaagatgcgacatggaaaaaagcactgtgtccaccctagttcttaaatttgggcagggatttggggtgtatgttaagagtttttcaaatttgccagattgtatgcctatgttgttaaatacacagtgaatctctggtatgatagcagtttctggtgggagatgcataggactcccacaggcagagtgaaataagggcattttagatggacaaacacacagacaaaagcagaaatgtgggtggtgtgactggggtatggtgaggggctgctgtggctggaatggagggctgccacaataatggaaatggtaaatgaggcaaataaggttggactggtggcatagcgtcaaggttgccagctttattaaatcactcttccaatatgctagcactggcctgttgggaaaagtaatatatcatgtaatcgaacaaaagacaaacagaggcaagctccaggaatgggcactgtaaacaggacttgccccagagtagccagatgtaggctttagataagttgatgcaggctgagcatctctaatctgagggggaatgtctcacgtggtgtccaagaaatggtgacacatctcacagagggtctaggctcaggagggctagagtatgagacgttccccctcgcctgcgaacttaaaaatgtggccaacaatttttgtaaaagatggctactctgtagtgctttaactggacctatttagacaatgccttacacactggaggacgatactgtgtaaatctaataagtctacaagacaatacttctgtcttttggctctctccttcctctccagggtgatgacaaatccgtgagggtggagattatacctctctcatcatttcagcaccaaggaaataaattagtggcagagtaagggtgacttgatgagtacatccaattgttgacatagttttgggtggagaaattttgctattatatcgacttcttaaaatagtctagtgggattaacttggtttcaattcacagagatctggaagcgaggatcttttaaaaatcctgaaatatacactgcaataaaagaacaaagcatacacctcagccttaaatgactgaagaagtatgtcaagtagcagcaggtgggaaagtggctttggttttcagtttgtgagctctgaatccacacaaaaacaggactgcattctgaaaacctgaattaattattgtccttaccacaatgaggcagaaaagtataatcaaaatcattagtatttcagtcacaattaatgccaagatgagtttgtcagtatagccgtatcctggaacttcttttgtgagctaaaaaaaacaaaaaaacaaaaaaaaaacacaccagaatgagagctaactattcaaaaccccagtattccaggtgagtagcttacaggttcttttttatttttttgaaagagggtctcactctgttacccaggctggggtacagtggtgcaatcaccgttcactagactcgacctccctgggctcaggtgatcctcccacctcagcctcccaagtagctgggactacaggcacgtgtcatcaacccagctaatttttttattttttgtggagacaggctttcactatgttggccaagctggtctcaaactcctgacttcaagtaatccacccaccttggcctcccaaagtg

SEQ ID NO: 87 - DNA, 5001 bp, Homo sapiens
gccagactccctctcaaaaaaaaaaaaaaaaagacgtaaactgggtatgtgcctttagaggtggtgcacatttttagcattataaatgaatataaatgagtggcaactgttactttggtccacagatttttggtatcttaactagtttttggtctcttccactaaaggcattgcctgttgaaccttgttaggaatgtaagtactgaaggcaaactgcctgggtttgaattttgttctgtcccttgcaccctgcctcgtttcaaatcctagctctgcttattacgttcttttaaggggatgacctttgagcaaatgtcttagcttctgttttccccagtaaatggacacaatagttgctactttgtgaaagattcatgtaattgaccagcatttaccaagtagcatcagtgtttagtttcagtcattggtgattctgcagttggactgtgagggggtattggggtggggggtggtgtgtgtgtagcacttaattgcaggcaggaaggaaaagatacttttgataaccgacaggcagcttttctctgcttttgtgtcaaaagggaggaagggagtttggagagggaaatgaattctctgtaacactaagctctcttcctcaaaaccagaggtagatagaatgtgtaataatttacagaatttctagacttcaacgatctgattttttaaatttatttttattttttcaggttgagactgagctaaagttaatctgtggcgacgttctggatgtactggacaaagacctcattccagcagctacaactggcaagtccaaggttttctatcatgaaatgtaggttctatactaacaattaacaagtgtacttcaataaatttaaacattctcaggaatagttgactttgtttctttttttcttagacatttcatattattttccttattaaatataaccaaaaatcccacagaaattaactgaggagcctctaaatatcaacaaagttatcacttgatagactagaattaaacaagcaagtggttccaagaaatggcacgagtgtattaatcataaaataaaatttctacatgaaacattcagccattctagaccatttctgtctgtgcagactcatcttttcctgttctttgcaaagcccagctagagcaagcaagttcttcccaataggtttttcccatctctggttgcttggctggctgggcttcctctacaaacccccttcctttcccctaagcagggcccggtgtccccatcccgcggagttgagctcatgagggcatctgaccaggagtagctattcctggtgctattgtcattgtcctgtttcatgtgtgaacatggctggctctacagagatttggcgggtagcaaggaggtttctttttgaatcttcttttggaagtcagacttgatgaggatcttatgcccactttttcctagctctgtggtgtcaggcaaagtctgtttctgcaaatgggggttaagaattcctacctcacagcagtcttttgataaataaataagatcttaagtgtaaattattccactagaaattgcacagtcactttggtcttcatcctggaggtccactgacaagcctcatgcaaacctgtggccctgttcataaagtgttttgatccatactttcaaatggcctcaggaagaccttttataaagtaaaaatgttaggcagccacatgatatccattgacccagtgaggctgttttactggatataagaggtttgacccggcattttggggggccgagacaggcagatcacttgaggccaggagctggagacctgcctggccaacatggagaaaccccatctctattaaaaataccaaaaaaattagctgggcatggtggcacatgcctgtaatcccagctacttgggagactgaggcacaagaatcgcttgaacccgggagtcagaggttgcagtgagccaagccgagatggcgccactgcactccagcctgggcagcagagtgagactctgtctcaggggaaaaaaaagggtgaggggagggtttgaaaaaatagtagcatgtagttatgtttctacaatatttgatatatataaggatttaccaacctcttgcattagctgctatcccctacagcagttgctgtaggaaaaaaacatcaagttctgagctcctactgtttgccaggcatattctgagatgatcacgttgaaatctcagagttaccctgcagagtagtcagggtatcactgcctgacagatgaagaagctgaggcttccagcagataaatgacttaccccaggccacatagaaaatgagtgggagagcccaggtctgtctgtgaggtataatgaaattagcataaaccctccacattggcgccactcgcataaattaacatatattctctcacagaaagtattttattgggcataacagtttgtatcatttaccgtttaacattagccgtggatcttcccacatcacatgactatgcctcattctttttggataatatgattactattgaatggatttactatcattcacttaatcaatactccttttgatggccattttaattgtctattttttccttttgcacagattggtgtaataaacgtgattttatagtaatatttttgtctgcctgtgaaaatgtttgctggacaataaattcctaggagtcaaataaggtcaaagattataaatacagtatttattttcataaatattaccaagtcagccacaaatgtttaaattactaatggtttcagattattgtatttaatgagtaaacacttttatagggtttacttttatgaacacttttatttgccagatatcattctaagtcctttacaaaattaacttttttaatttgtaatataaccctgagatgtatattaggattatccccattctacagataagaacactgagaagttaattaacttgccacatatctaggaagtgacaaggctagttgcacagccaggcagtctggctcctgagtccacattttagacaacactatacctcctggttcttttgaggcattactgctggaactatcctaatactcataaataaacatttcttttggggagggccaaataaaattttaaacagaaaagttttcaccaactgtcaagctcataaagttgtacgttatacacttttttcatgatgcccacagataatttattaatgatatcatctattttaaaagacgtatgtaaaacccaacccttaagaaaggattcctatcactgttcccacaggcaccctcctcagtcttatacctttccattccaccccccaaaacaaatcattcagcatatttatttcatactgtaatagaggaagtagcttctttttagattttcttagattattaacattgatcatacaaacatggaatagaaattccttatgttttatctggatttaaggtgctacataatggaatctatttctatcaagccatacacattggagataatgaaatcacttgtgttctagcctaaacgttatgggaatttcagaactgcaacataacagataatccttggacgaaaactaaatctctcctctggtcaggcatctatgtgcatcagtgaagagaagacggggactgtggaagggaaaacagtgagtcaggaaggactgtggccacatctgttccccggaccctcaagtagttaaatcctgacctcctctaccccagactgtcctggggaacggccaacactggcttttcacaactgtgtgttaccagaaatgcaacagaaacccagctgaatccccagggtttcccttctgcccttctcaatggaaagatctgtcccaggaccatttattccaacattttcaattatgagaaatctgggaagataaagttattttcacatttctcaagaaatacatacttattcatactcatgacaggaaagtcagaatctacagaaaaccaagaagatttttaaaaatccatgataccaccatcaaaagagccacacttagtatgttggtccacaggtttcctagcacccttttctgttggtgtatgcacaaaatacacaatcacattctgtctacattttacaatttgccattttttgattaacactatatattgaccaatttttaagacctgcaacatatgtcgacaacattatttcagaataatatatttataaataaacgcacacacaaactgtctgtcttatatacaacacgtcttactttctaattctccactctggaagatttaggttttcctaactttttaatatactcaccaggaatcagtaaactttttttataaaaggccaaagggtagatattttaaactctgcaggccataggtttctgttgcaacactcaactctgctgttgcagggaaagaagccatacacaatttgtaaatgaatgggcatgactgtgttctgataaactttacaaaaacaggtggtggactagatgcagcctgctcctctggacatggcttaccagcccctgacatataccactacagaggatgctgttagaatgaaatctctttacacatctctgatcatctccttaggactaattgctagacatgacatgatggtagctgtgggtcaaagggcatgcacgctctgggatgtacattgccagattgctcatgatcagcctttctcatgtcaaaatgttttgtgaccaccagaaggctggttctgcttttattatccattgactgaggagtagaaatgacatggcatgtatgcaggatatttaaccatcgtatagataatccttgtgcacaagtgcattctatattctttcccaataggtctacatctgccagagttgaaataaaataaaacaaaacaaacctatttagcaccttctgtgtagcaggtccattcatgtatgttgttgtatttcattctcagaattcttatgacctaggcattttaaaaatttttttaaaaatattgagttgacaaggattgtgtat

SEQ ID NO: 88 - DNA, 5001 bp, Homo sapiens
atctaggtacctcacactgcatttattcacttaaatcatcaattcatataactttagagatggaagagacttgactgaggtccagctgaggaaactgagtctcagaaaggttgggttgtggttcgtcagtatagagctcaggtttccaggctcggggatccatgaccttggtgctgtgggctaggctgagaggtccctgaaggaaatgcaagaaccaaacattgtgagcaaaagcttggactttggcagaggctataacttctttttactctgagtaatgcttcattaatcggtttaggaattaacaagatactgagacttgggccagtatgggttttcaaagattgcatgtgtctccaaacaccacctctgagttccttccagggagtagcccacatgaccattggtctccagtgaatcaccaggccacatttgctgaagtaaatggaagcattgcgagagcagaaaatcaggacagacacctatacttgctaacccaaacaaccgccctttctgagccactggagatcagttatcaccaaatggacagatacactcggcaaagtttttgcaggcttcacagcttgtaaataagagactgcattcttcatgctccctcttgttgaatctggcagagggaagacctctggctctaatcagctgggcaatgaccagtagctgggctggcaggaaagagtgatgactccatttgaataaactttgtgaacccactatagttaattcagaggacccatatactaagaacacagggcttcttatccatggaaaatcatcctgggaacaccggttgcttgttacttataatttataatggcataccaaatacaaattggcctgtgtggaatacattggcatagatttaataatatttaacatttctataattcaacattctgttcattctttcttatattcttttttttctcttttttgccatggagtctcactgtgtcacccaggctggcgctatcttggctcactgcaacctccgcctcccgggttcaagtgattctcttgcctcagcctccgagtagctgggactataggcgtgtgctaccacgcctggctaatttttgtatttttagtagagatggggggttcatcacattggccaggctggtctcgaactcctgacctcaggtgattcacccgcctgggcctcccaaaatgttgggattacaggtgtgagccactgcacccggcccattgtttcttatatacttattattctttgtacttttaccaggacttccttctttgtagctttgtttaccctattcttccatttacattttaccgatcacttgagtctccaaaaaaaatttctgactctttgatatcactaggcatgatttccagttgagtccttccaggagaaatttcagaaggtgcctccttttctttctaaatgggtcagagatacctttattttggaactgaccatgggaagccttcagttgtttatatcttgaattggggcagcagatggagcttttctcccctgtccccagcaccatccaaccttctttccttgaccttttagaagcatttgacattgtggccctctccatcttacctgaagccttctcccccttttgactccggagacatcatagataaatcagggctgtggtgaaatggaaacactgtgccttcagagtcatgcaaatgggggtttgaatcttggctccacacagcagctctgaggcttgaacaagttctggaatctctcaaggctgcagtgctcttatctcaaaaaggagggtgacataatctgcctcgtatgccagtcttcagccttgaagccttattcaacttctgctttttgagggtaggggcagagtttgtaccctggaacatgatgctagcatagtgcctttcacaagatgggcactcactaatttatctgctttccacttcccattttcagcctagagtcacaccattcattcatgctccatgtgttagggttctccagggaaacagaaccaataggatatatacatatataatccatatattggatttttgattttatatatatccttgaatatatatatatatatatatatatacatatatagagagagagagagagagagagagagagagagacagagacagagacagacagacagagagagagagacagagagacagagagagatttgttttaagaaattggctcatgtgattgtgagggctggcaagtctgaaatctgtagagcaggccagtaagctggtgactcaggtgagaactgatgttggtcttgagtctgaattccacagggcaggagtctggaaatgcaggcagggtttttatgatgcagtcttgaaaataattccctttttttttgagactgagtctcactctgtcacccaggttggagtgcagtggcttgatctcggctcactgtaacctccacctcctgggttcaagtgatcctcctgcctcagcctcccgagtagctgggattacaggtacctgccaccatgcctgggtgatttttgcatgcggtttcaccatgttggccaggcagggaaaagaatttcttctgggggaaacttcaatctttactcttttaggaccttctactgattgggtgaggcccacatacatgatggaggacaatctgcttcaagtccactgatttcagtgttagtcccatctaaaaaataccttcacagtgacatccagactggtgtttgattttttttttgtttaaagtggaggtcttgctctgttgcccaggccggagtacagtggtaccatcgtaattcaatgtagcttcaattcctgggctcagggatcttctgcttcagcctcttaagtagctcttaagtacaggcctgtgctgccatgctcagctaattttttttttgttgttgttgagacagagtcttgctctgtcacccaggctggagtgcagtggtgggatctcggctcactgcaacctctgcctcccagattcaagtgattcccctgcctcagcctcccaagtagctgggactacaggtgtgcactagcatgcctggctaattttttttttaatttttagtagagacagggtttcaccatgttgatcagactggtctcggactcctggcctgaagtgatctgcccacctcagtgtcccaaagtgctgggattacaggcatgagccaccacatccggcctaatttgttttgttttgagactcagtcttgttaggttgcccagactggtatctaattcttcaagccattctcccacctcagcctcccaaagtgctgggattacaggcttgagccactgcaccaagctgtggtgtttgatcaagcaactaggcaccagagcctagctaggctgacacataaaattaactatcgctctccacacgcttggccactgatccttagcaactgggcctcagtccaaagttagagagcttaactgaagaggacattgtgatgatgaagcttgccgggggccatagggatctctgttagaactccctcaggatcggaattctatgttattgctggaggcctctctgagggttcttggggaagttatgtagaaggtgcctctgctgaagtcctggagctgaccactcccaccggcttggctctgggctcagctctgtcatggttgaactgtatgaccctgggcaagtcatgggctcttctgggcctcagtttactgtctataaatagggacatttggacttgatgtacctgaagttcccttcttgcttttaaacagcttctcagctccttttgttttaccactagctttgcagagacttgttaggaatttacagcttgtgattgcttcacttttttggaaatggctctatggtttcaaacaacattaactttaaaaaattaacaatgctgagcgtggtggttcacacctgtaatcccagcactttgggaagctgaggcaggtggatcaccggaggtcaggagttcgagaccagcctggccaacatggtgaaaccccatctctactaaaatacaaaaattagctgggcgtggtagcacatgcctgtagttccagctacgggggaggacaaggcaggagaatcacatgaacccaggaggcggaggttgcagtgagctgagattgcgccactgcactccagcctgggagacagagtgagactccatctcaaaaaaaaaaaaaaaaaaaaaaaagaaaagaaaagaaattgacatcatgtgtttactgactagatgcttttttttcttttaatcactgcgatgtcattcatctagtgagcgctcaatacatgtttttttggattaaaacatattttaaaaatttatatatcattaaaaagacatttgcactacagaagctcctgggtgatgataggtagacccaccctctccattaactatcttgtagtttagaggactccagagtatattggaaagaaccaaggctttgcaataatacagacctggacttaaatcctgaattttctacttgtcagctgtgcaaccgtggtcataattcttaatttctctgagactcagtttatttatctgtagaattggagtaatgggatatctcccagagttgttaaatgacatgtatgtgaactgccaagcatacggcttaatagagtaaacttgaaataaaaatgaggtattttttgttctcttcccttggactgtgtgtggagtcctggagcactgtaatgccactaggaagtttgaggcaagaggctctcttccagcgatgtcaagaaacttattgcttttttttttttttaatcacatcagatggatgtgattaccatctgagtgtgtcccatccaacagaacggggttaggctgtgaagtgctttgcttttaaaacagacagtcctgtactctaggaatcaacagtgcttccctttcaggaagaagtgatgaatcattacaggaaatattgtgtttttttttcccctcaagtatcttaccaatgaaagttattaaaaatagaagctt

SEQ ID NO: 89 - DNA, 5001 bp, Homo sapiens
agcatcagaattagaagatttagaagtaactagaattcttcctagctccactggaaaggatgaacatgggggctcccgcaagataagtacagggccagtggacagtgactggtctagtgagaatagaatcccaaagatcctgggaaataaaattacacaacaagcttccaggaaacaagtggaacaaacgaggcaacctcgcagatactaccaggaatggataagcagaagagggtcagagccacaaaatctaaacaaaagacaccaaaccacaagaagcacccagccctgtgaacaccagctgtggctacatctgtaccaatcttttcagacagctgccgtgggactgctgagagcagccacacaccaaacagcagtgcatctgaacacaagtcccaagacactcctctctattaatcctcattttgagaagatggatatggttatgttacaacatccccatacaacacttgtgggcgagggtaatcagacaccctcacctaaagagggcacaggaaggaggaggatgaaaacagagggctagggaagggatgtgtgctctggatcacatagactttccccacaggcactatttaaaacaaaagaagagccctagaaatgtgctgtggtctccctatacttcctcatcttgccacatgcataggtgccacgtggttttgttttgttttgttttttgagatggagtttcgccctttcgcccaggctggaatgaagtggcttgacctagactcactgcaacctccgccccccgggttcaagcgattctcctgtctcagcctcccgagtagttgggattatagcgcctaccaccacgaccggcaaatttttgtatttttagtagagatggggtttcgccatgttgactaggctggtcttgaactcctgacctcaggtaatctacctgcctcggcctcccaaagtgctgggattacaggcttgagccactgcgcctggcagatgccacaatttttttttctttctttacacaggtgctgatgaactcaggtgtaattaaccctaaggggtaaattattcactaagtgcagtaatagggtccaatttttatgaccaggttttcagttctttgatattgtcctacattcagaaatcacaaatgaaaaatactggaatgtgtgacgtgaacaatgtcttggaggttaacatccaggtttttacatattagatgtaacaacatgaaagctggtaccatctgggaaccaaaggaactgtccctgagaacacagaattttagggacatcaattattaagagtttacatggaagcagaagtgctcctagatgtttccattatctagatagaaaaattcaacagatgagccccagtgagtcaaggaacatctctgacagctgtgggtgatgggctttctatccaaagcagagatgtgaaacctgacgggtttcaattgaccccgaagtgctccatatctcaaaagtcaatcccacaaagctggaacgctatctgttcctgagggatcaggtcccacctgtgtctctaagacactgccttgagatgaggccgatgatttcaaacgtaaattgcctaaattatcatcagcttcatgttgtgttttggagcttgtccacttaagtgggttgataaaaaatggctcacaagacacatgcctgggaaatggggttttcttctttgctcttggcagatcctgggcaaccctataattaaccttcttgatttctcaattttcacattcgcgaaaaaggtgccagtgcgcgtgacatttccctgaagccacagcccttgtcaccccctgcaaagctctgaagttgtgcacaggtaggccaggtggcagatttctctcaaaagcggctgagctcgcgctctggctagggaaggcagaggcctgcggcacaaagtacattgtcttagacatcaggacagtgtctatagcagtttaggaaagaaggcggctccctgggctggagacgacgcaatgctctgggaagacccctgggtgcgggtgagagaggaatccgagctgcacaaggccaatgaggggaggacgacccgcccgatttagataaaggtaaggcatacttcctagcttaataccctcctcaatgcccagcccagacctgcctttcacgtccctagctgtattcactctccctggcgaccgggcggcgtagaatcggcggccagcagtgctttagacacaggttaagtgtctgcccctccctccagggttacgcaccaccccgatgcatactgggattgtagttctgaagctacctacccatgggctgagagcagtaaagagactacaactcccagcataccaggcgcggcgcgcaccgccctgccccttcctctggggttgcgaaccgcccccgagcctggtacaggctgggattgtagtcctgcagccttgtggccgaagggctgggactggccatgagattacatgtcctagcatgctcagccaggcgcgcgcagctctgccccttcctccagtgatgcgcacagtccctgatccctgtgcacgctgggattgtagtcctgcagccctgcgatcacttgcaggtaacaagaaatttcagcttccggcatgatgggcgaaggcccccaccttcagcctcgctcctccatgccttcagagctgttccgccatgcagacggggagcctgcctgttctttaacctctcctacctgatgggagaggacaagctaccaggacagcttgtctcaccaagaaattgtgataccgcatcccccaacgtgctggcttcctgacttccaaagttgcggtaagtttgatttctcacagaactgcaagagtccgggatcgtttcccagcctgcccaaagttgccatggttctcaccctctgggaggttggcacacccagtgacaccttgtgtcccttgaaactaatctgtgtcaccttttaggcttttgagaccacttgaactctgactttgtggcatttattaccaaatctactaaaatgggtcaactgtcagattttaactccttttccacacatgttggttaggtaatctgttgattagacatggttttctccaaaaggggattatctcttcctgattgcctccaagagaaggatgaaacgattgggcgctctaaggatctatttcccaaatttgagattccacactgatcattcctgggcaaaatgtgtctttctgttccataaccacaatcttaggccagcctgagtgccatcccagcccaatgggggttatggaactccaacttagttctgtttaagttttatgtaaatatccttgtctctgtttcacctggctctgttagataaaatgtctaggagaaagtaggaggtgacaagaatacaggtgaaatcataggtactggaatggggcacactgattctgtggaagcagagggagaacaacaacctaaaacccagggaatgaacaacttagacctcaggagctgtggggaatggaggggcattaataactttttgtctttctgaattacccctggtgcaacccagaaaagagtctgggaatcttgttgggccaggacaaaagtagttttagttagaccagaaggtaaggcacaagctgtgaattcatctcctcctttggctccccacattaaccttaagaatcctttgagactgttctgtctctctgtgatgtaggtgtggaattctagggggcagcgtgcactctcagtgcccagctgtctgagaccacagttccctcagatgatgaatgatatggtttggctgtatccccacccaaatctcatcttgaattgtagctcccataattcccgtgtgatatgagagggacctggagggaggtaatcgaatcacgggtgtgcatctttcccaagctgttctcgtggtagtgaatatatgtcacaagatctgatgattttatagagggcagttcccctgcacatgctctcttgcctgccaccgtgtaagacatgacttcgctcatccttgccttcctccatgattgtgaaccccactgccctgacctacagccatgtggaattgtgagtcaattaaacctctttcctttataaattacccactcttgggtatgtctttattagcagcatgagaacagactaatacaatggagaaccatcgcttttttctgaagagactcagtcccccatgggtaagcttaagctggacgctaggcagcactgattatattttctccttctgtgaactggagctcctccttccattttcctaccaccactaatctttttggtcaatatttggataaattagagacatagataagggaatgttagccccagcatagctagactcttgcttatttctcttcccggtttatgaaatcaattatgttggcacagagagatacccttagatggggtcactcaggagcaattagagcagtgtacttctagagaagctgataggacagggcagatgtgccagtgaggatcacagcttctgtctaaatttttgagtctatctgtgtgtggcagatgaattcaggaaagatcccagatccctggaaagggaccattaagagaggattcatgtagatcagaacactagggcatgtgttcatcagtgaccttctaagtcagattgacagggttaagtctgtggtagggctacagagcaatgcttgcccatgaaagcctctgatcatgtgtaaaatatgtggttctggcacggggagacatctttatctgacagaacattgtacttctgtggatgtgggattctttgctcttccttaacagtgcaccactgactgattgtttgagaatcacgcatacataggcctgtttattttgaatttcttaaatattggaacaggaaaaaacatttttatccactttttttcttttttttgagatggagtcttggtttgtctcccaggctggagtccagtggcgcaatctcggctcactgcaacctctgcctcccagattcaagcgattctcctgtctcagc

SEQ ID NO: 90 - DNA, 5001 bp, Homo sapiens
cctctctactaaaagtacaaaaatttagccaggcatagtggcgcacacctatagtcccagctactccagaggctgaggcaggagaatcacttgaacccaggaggcagaggttgcagtgagccaagatcacggtactgcactccagcctgggtgaccaagtgagactctgtctcaaaaagaaaaaaattatcaccattatgaaggcaatcaaagaaaatcagtcaaaaatatagggaaaaagtatgcaggtgtagcagacaggtagactatactattaacaaacatagtatgccatttttctgagttgtctcatattttgacattttagattttgtgatttgatgtgttttctcagtccaaaaatcatcctatgtgtgccaaattttgtatttttgtatttttttttctaaagagtcacaaagactctcttcttaaccaaacttatgaaagctcctctgaacccttttttcaactaggctttgtccttgggactgccttgtccagctgtagcaagaatcctgctaagttggttttgcaagactcttgatatctgatcgccttcactatctgatcaaattccctagccctcacccttggtatctgatcatgctggcctgctttcagcaagaatcctgttaagtcagtttagaaagaatcccggtatcttcagtgtctcctcttagtagttttccgtccactaacacacacggccagcctccctcacctgctgcactatgcttcttgcccataaacccccctggtctttgctgtattccgagttgagcctgacctatctccattattgcactagtctttttttttttttaattgacttctgtttttttcttctgagacggggtctcactgtgttgtcccagctggagtacagtggtgcaaccttagctcactgcaacctccccctcccaggtacaagcgattctcctatctcagcttcctgagtagctgggagtacaggtgcatgccaccatgcccagcttatttttgtatttttagtaaagatgggggtttcaccatgttggccaggctggtctcgaatgcctgacctcaggtcatttccctgccttgcctcccaaagtgttgggattacaggcatgagccactgtgcctggcctgcactagtcttgatacctgtctcagtcatcctgaatagtcaatgttaacaggtgtcagaataattttttcttttttctttttcttattgcaaattctgaactttattcctcatttgaactgtgaaagtaattcatcataccggctagtaggatctaaagataaagacttgattatgtaggaaaatggtatttttatctttatattaaaatcttaatattaaattccctctcctaaaatacatagtatggcttctgttttcacatcagccttaactaattaaatctcaagagatgaataagtgagcattgggtgatttcaaatccctttatgatataattcatagccaactagaaattctctttagagaatttcccaaacaagataaagggtgtcttcagcaaacatcatatacctaatgaagtagcttcaggtcctagcataataaggcaataaaaataagcaaaaggtacagcaattacaatgaaattttaacagaggtctttatcaatgacatgactgcacatatagaaaaatccaggctaagcgtggtagctcacgcctgtaatcccagcactttgggaggctgaggcaggcggatcacgaggtcaggagatcaagaccatcctggctaacatggtgaaaccccatctctactaaaaatacaaaaaattagccgggcgtggtggtgggcgcctgtagtcccagctactcgggaggctgaggcaggagaatggtgtgaacctgggaggtggagcttgcagtgagtggagatcacaccactgcactccagcctgggcgacagagcgacactccatctcaaaaaaaaaaaaagaaaaatccaaaagtatatacggatacatttgaagccttaataaaatatttgcaagacagccagagattaatcaaattacaaaatcagttgtctttccacatcacagtaataaaaatggaattttataaaaatgccattgacaaaagcttcaaaaattatgatataatttatcaatatcaaaaaatatgatataatttttgaatatatggaatatatctaactattagagatgtatctaacaaaaatatgtatatgtcacctctatggaggaaattataaatctgtattcaaggacattaaagatgtaaataggctgggcgcagtggctcacgcctgtaatgccaacactttgggaggccgaggcgtgtggatcacctgaggtcaggagttcgagaccaccctggccaacctggtgaaaccccatctctactaaaaatacaaaaattagctgggtgtggtggcaggcacctgtagtcccagctactcagtaggccaaggcaggagaatcacttgaacctgagagatggaggttgcagtgagtcgagattgcactattgcactccagcctgggcgacagaccaagactccgtctcaagaaaataaataaataaaaaataaataaatcaagatgtaaataaactgaaaaagaggccatgttgatgagtttgagaacaatattgtatgaatgccaattttacccaacaatctacagcatcaaaggaatatgtcatacaatctcccgggtgatttttgtgcaatttggtaactctattgtaaaatttatactgaagtagaaatgttcaagtatggtcaaggcaaccatgaagaacaatgaatggctttgcaagataaaaagatgtatcataacattacagaaaatatgaccatttcagacggggcacagtggctcacatctgtaatccccgcactttaggaggccgaggcagatggatcacttaaggtcaggagtttgaaagcagcctgaccaacatggtgaaaccctgtctctactaaaaaataacaaaaattagctgggcatcgtggcatgtgcctgtaatctcagctgctcaggaggctgaggcacaagaattgcttgaacccaggaggtggaggttgcagtgagctaagattgtgccactgcattccacccagggtgacagagtgagactgtctcaaatttttaaaaatgtgagaaaataggcccatttcaatggttcacacctgtaataccagcgctatgggagaccgaggcagaaggattacttgagcccaggaattcaagaccagcctgggcaacatggtgacaccccatctgtacaaaaaacacaaaaattagctgggcatgggtggctcatgcctgtagtctcagctacttgagaggctgaggtgggaggatcacttgagcccaggaggtggaggttgcagtgagccaagattgcagcactgcactccatccaaggtgacaaagtgacacagtgagaccttgtctgaaaaaaaaaagtgacaattatgtattgaccaagtggaacaaaattgagtgcctggaaatagacctcaaccacaggaaacatcaagtgtgatagaggaagtggcaaataataaatttttctttttatttattttgggtttttatttatttaattttttttgagacagtgtctctgtcacctaggatggagtacaatggtgtgatcagggctcaccacagtctctatttctctgggctcaggcactcctctcatctcagcctcccaaatagctgggactacaggaatgcaccattatgcttggctaattttttaattttttgtagagacaggttctcactatgttgcccaggctggtctcaaacttctgggctcaagcggtcctcccacctcaacctcccaaagtgttgggattacaggcatgagccactgggcccggccaacttttcaaaaaatatctgtgggcaaaacttaatgcaatcaagtttgcagtaagtttgcaatgaaatttgactcccagctcatgcataaaagtcaagtacaggtagcttgaaggtctaaatatgacaaagaaaacaatagagctgttagaaaataatatagcaggaaatcgccatgaatttgaggtaggtaggatttctgagcaaaacataaataacactatttatttatttgtttatttttattatttattattattttttttgagacagagtcgtgctctgtcacccaggctggagtgcagtggcgtgattttggctcactgcaacctccgcctcccaggttcaagcgattctcctgcctcagcctccggagtagctgggactacaagcacaccccaccacgcccagctaattttcgaatttttagtagagacggggttttaccatgttggtcaggatggtctcgatctcctgacctcatgatccacccaccttggcctcccaaagtgctgggattacaggtgtgagccaccacgcccagccaataacactatttataaagagaaagattgaaaacttgacccctggcccagacactgagctctacctctctgaggtcttgcctccacaggacctgcacatccaaaggtcttttctccccaggaccctgacatcctactccagctcccataagccatgctaaggaggctgattctctccatgtttctctggcttccaaaggggaaaactgaagggcacctgcagagcacctgaagcccagaagtaaaggtgaccactgagacaaggagtgaggtagcagtcatgggtctcaggtccctgaaaggagaaggcagcacctttttgagagaaggtaatgggtgtttcctctccatttggctccagggtcccttcggagtgatgagtaactccatgtgtggtcccaccctcatctccacctcttgttgctcactcttggagaacttgtgcccctgtcactctcacagtgactccttaggtaaaaggtttatgttctaccacatcctcttaagatatatctcccactaactcccatctggaatcccccagtgctcagagaagagttatt

SEQ ID NO: 91 - DNA, 5001 bp, Homo sapiens
tgtcctgggagcaactgaggaggtgacattgatcttgggaattctattttttattttcaccctctctttgtgatcgatcactagagaacagttaccacgtgcctggctgcagtgagttttaggattccaggatcccaggtgtaggagaatgtacaaaacattaggtcacttgtttccttgggtgagagacagagatacctgtagggccagccccaaaccccacctggtcctctcaagcatttgtcccactcaacactagaggcatctctcaagctggagatcccagatcttgccctgggacagcttcattcccccaacccccatcctctgtgctgtctattaagtgcaagaaacaaatggggtgagagaagaggaaattgcaaccagaagccacaagatatagacagaagggcagaaaaggaaatttccccacagcctctaccaggaaatctgggccccaagggcaaggaagaggccaggctggcccacctcaggggcacaatgcccattctaataaaagtaaagtaacacaaaatacagaattggatgtaagaaggaaaaaaagaattgaggtaaagaaattaccattttcacattcaagaagggctacagagtttgcctcaagagaaaagtgtgtatatagtttatcactactttgttttcaaattaaactggtgataatattttttattgaggtgaaattcagacgaaaaaattactagtggtaattttggatgtataaacttttgaaggatgaggtgaagaggaagctaaaatgatgctggataaaaaaaggaagatgaacgttaaggctcccccttgtggaggatagagaaagcatttttaaaagttctggattcagtggcaatgagatgaggatttgggggatgacctcttggactcaacaacgtggtactaggacacaaaatccagtgaaagactttctgtggtggggatgaatggtgaatttttgcaacacgatgtctagcatccaatttaacctacttcttatcctgaagagccattcctttctgctgctcccaaaccttgaatgaagagtgctacccaaaatatacttgtacaaagtgctgggaaaggcaggaaagaagtctttgttctcacgtttggggaagggataccagcttgcatatgtcaatcacccatcaccctcaggaactctcccacatattgtggtaagttggcagctttgggttctctgtgattattaagcatgagagatccagttactttctggggatcttaaaatctgaacaggatgcaagatttgggaattactggtttgtaccatcaaaacttaaatctgctcttaaactcttggaatatatcagcctggtgcagtacaattttaacaaattcaaagcaggagaggaggagctgagaacaaagttacaacctgtgactgagttgatggtatgataaattgaggcaggaattatgtggaggcaattatgaaggactccaactaggagaggtgtggactgagagaacaccctggtagctatgaagtctttacttttgattgggcatccattggatagatatattcagcttacatttctattatatttgattgaaagtgttgacaaaaaaaagttttattttggtaaaataatgcataacacaaattttaacattttaaccacttttaaatgtatggttcagtggcactgaatatattcatcttgttttacaactgtcacaaccatccatttccagaactttttcatctttccatactgaatctgtgtactcattaaacactgactctccatttccttctcatcccagcccttagcaagcgtcattctactttctgtatctatgcatttgactatctcagtatctcatataagtagactcttatgacatttgtgcttttctgtctggtttatttcacctagcataatgtcttcaaagtcatacacattaaagcatttgttagaacttcattccgttttaaagctgaataagattttatttgatgcatactacattttgtttctccatttatccactgatagacatttatgttgcttccatgttttggctattgtaaataatgctgctgtgaacattggggtacaaatatcagactccctgctttcaattctttggggtatctactcagaagtggaattgtggaattgctgaattacatagtaattacatgctttgtttttcgaggaattttcataccatcttccatagtgactgcaccattttacatcccaccagcaatgcacgagggtttcaatttctccaaatcttcaccaatatttgttattatctggttttgttttgttttttaatagtggtcattctaacgtgtacgaagtggtatctcataatggttttgatttgcattcctgtaattattactgtttataaaattgtataagtatttatgtgttggaaattataaattagttttcaatatttcaatattgagaagtgttaaaataatatgaacttactcaacttacctttcaaaattggaagatctagcactccccttatgacagtgattaactggggatgaacaagaactgcctcttttactttgccacactttctattctgtactttggtggttcaagctatctcttccaatgaaaattacccaaacaataaagaggggaaaaacataggatggaaaagataaattgtctcagtccatttgggctgctataacaaaataccttaggctgggtgatttataaacaacagaaatttatttctcataattctggaggtcgggaagtccaagatcaaggtgccagcggattcagtgtctggagagaattatttgcttcccagatagtatcttttcgtggtatcctcacatggcagaagaggaaaacacacttccttctgtttcttttatgagaacactaatcccattcatgaaggatggcaccattatgggttaatcactttccaaaaagccccaaccttttaataccatcaccttgaggtttaagatttcaacatataaattttgggaagacacacatttctattatagcataaataaagtatatcaagagttaaagcatatagaaaaaaagcaaatattgcactctctttgctacatgcacttagggaaattaaaagaaaaacacctgaagtttataaaagttaaattcatgaaaaagaatgaagaaattataaaagcagcaagacataaacagatattgccttaaatggaaccacaataagaaaatgatgactgaattgtcatgagaaactcacccgccctccaaagtggaatgacatctccaaaaggttaaaagaaaaatgcaaagctagaattctacattttggaaaattatccttcaaaacgaaagagaaggagtcgtgcttttattatgaaggagtaagctcctagcagagtgaactcaccacaacacaacaaaacaaacaaacaaaaaatccttacaagttataagctttgaatggggaaaaaaaactacttgggaaatgggataaaagaaaatagattctggaacgggagtcaatatttggggaaaggcaccaacaaggaataaatagctttattccaatggtaggtcagagctacagtgcagaaagtggctgctaaaattctaatacaactccttccatctttctggactgagaaacaagggatgaagcccagggcaactaggaacactgaaacaacaggtaacaattctggaaagggaagagctagggaaaaggaactccagcttctgagtataaatgctttccatttcaaatataatgaggtgaggctaggacttaaaggatgtgaaaatgcatactatgcaaatactagtcaaaagaaaactggaatggctatgttaatagcagacaaagtacacttaagagcaaagaaaatcacaggaacaaaaagtgatgttacataatgtaaaacagttgattcagccaactgcggtggctcacgcctataatcccagcactttggaggctgaggcgggtggatcacctgaagtcaggagttcaggaccagcctgacttacatggtgaaaccttgtctctactaaatacaaaaaaaactagccaggcgtgatggtgcgtgcctgtaatccaagctatttgggaggctgaggcaggagaatcacttgtacctgggaggcggaggttgcagtgagccaagatcgcgccattgcactccagcctgggcaaaaagagcgaaactctgtctcaaaaaaaaattttttttaagttgattctttaagaagacatgagaattcttaatatgtatgcacctaacgacagagtttaaaaatacatgcagcaaaaactgatgaaactgagaggagaaactgacaaatccaacattaggatcagagacttcaacattcctctctcagtaatagactgagctggtagacaaaaaagttaccagctataaaactgaacaccattggacaactatgtctaattgccatttaatattcgtcccataacagggcaatacacattctttctaagcacacatggagcattcaccaagatagaccagtgtcatcaagcaaacttaaccaatataaaagactctcacggttggtgaaagtgaaagttagttcagccattgtggaagacagtgtggcgattcctcaaagacctaaacatagaaataccattcgactcagcaatcccattcctaggcatatacccaaaggaatataaatcattctattacaaagacacatgcatgcatacattcactgcagcactattcacaatagcaatgacatggaatcaacctaactgcctatcagtggtagactggatagagaaaatgtggtacatatacaccatggaatactaagcagccataaaaaagaatgagattatgtcctttgcagggacatgagtggagctggagaccattatcctcagcaaactatcacaagaagagaaaaccaaataccacatgttctcacttgtaagtgggagctaaatgatgagaac

SEQ ID NO: 92 - DNA, 5001 bp, Homo sapiens
cacatggatacatagaggtgagcaacacacactggggcctttcaaagggtggaaggtgggaggagggagaggatgaggaaaataactaatgggtactaggcttaatatctgggtgatgcaataatctgtacaacaaactcccatgacactttacctatgtaacaaacctgcacttgtgccccctgaacttaaaagttaaaaaaaatcatatcaagcatgtgtatttattaaaatggaacttaaaaagaaagtagtaacaatttgtttaaaaataaaaaaccagtaaaatctgcaatcacttagaaattaaacaacacacttctaagcaatccgtgaattcaaaggaaatctcaggggaaagaaggaaatattttgaactaatataaaaatacaacataacaaaacttttgtggtgcagcaaaagtgattaaagggaaaatgcagaaccagtggatacagaaggctgactgtacgatattaaaagcaaaaaaaaccccaccaaaactgagaatgagctattgatacgtgtaacaacgtggataaactgggaaaaccacactgaagaaatgaaagcagaccctaaagcaaatatgtttggttccagttatacgatgcacagaacctgacaatacaggtattgccttcttgtatatggacagaaggagaatcacttgaacctgggaggcagaagttgcagtgagctgagattttgccattgcactccagcctgggcaacaagatagaaactctgtctcaaagaaaaaaaaaaaagacataatttttgtctacaaactctcacagaggcattaaagagtaaaatcagttatgttgtattgtttcataaaagttttacttattttgtaacaattgtattggataataatcacaatgaggtagagttttaactggaaaacaaatgctgcctctctgtgcctatatggatagggaagctgaggagaccagaaattcaagtgttaagaaggtaacttttggcagccaggcacggtggctcatacctgtaatgccagcactttgggaggccaatgcagtggattgcttgaggtcaggagttcgagacctggccaacatggtaaaaccccatctctactaacatacaaaaaaaaaaaattaactggatgtggtggcaggcacctgtaatcccagctactagggaggctgaggcaggagaattgcttgaaccccagaggtggaggttgcagtgaacggagattgtgccactgaactccagcctgtgcaacagagtgagactctgtctcaaaaaaaaaaaaaaaaaaaaaaggtaacttttgggtaatgggtaatgggggtataagaccgaaagtacattcccttcacagggctggagatggtggatggagagggaagagaagggcaggtggagaggggatggggtgcagatggggatgcaggtgtggtggggcaagactcacaagcagaggggaataagtagaaggggtatggggcaggaaggaaaagaggggtagtcagtgggatgtgagcttccagaaagaagctgacagtgatgtcctgcatgtgtcccacagggctaagtgtccacacctcagttctgtcttgagcgggaggggctcagccaggcctctcagccctgctctgctgggggcctccacacctgcagagccaacatgggcctcagatcagcaccagccacttcagttctaattccaggtggggctgagctgtcctggggcaggacagctcagccccacctggaactcaggagcttcctggagacaggcagtccggctcacctggtatagtagatccaggtgaggccataggtgaggaggaagccagcccccatgagagcccccctgatcagggtgaggacgaggggccaggagccctgctgtttctcagttacacatatgcaggaagaggagcttcctgggagaaaggagaaggtaaggtgctgttaccaggcctcagtccctcccaccaacctgaatacctcaccgggctgtctaccctcagcacctgtcctgcaactcactctgcacagaaaggatgaaggacaggtgctgggagcccagcggatgctgaacccggcaggtgaattcccctccctctctagctcctatgttaggcagctccagggtcccagacattgaggtctgggaaggattgagggcttttccctcccggaaccagctcagtgaggcaggggggttgctgtcaactgtgcaggcgaggaacagggactggccctcctggatgggcaccgacatgccattgctcaggatccgcagggctgggaaagagaagcacagccaggtgagtggagctgggaggcccaattctccctcattcctcccactgagctgcaagaagaaagacaagactgtgtggtgagtgctgagaatgggctagtcatgggtgaaaggatgaggacttggtgatcaggtcaggctaccagaaagaaggtggctgagctgagaaaagacagatgaggaggagttctcacattaaggagaagtggatgggcagctcaggtgcagacgtgccaagaactgagacaggcagacgaggaaagaggctcctagatccgcaacctgtcagggaggacccagagctcccaagacacgataatggaggtagaagcaggctcagatcttttggagcattgggtgccagattgagggccttgggctttatcctggaaagcaagagggggctataagcaagggaaacagagttagcactggatctagaaagatcctgctggagccaagtaggtcccggactggagagaagtgggataggaggcagggaggctgggaggaggctggggcaatgggccagggttgagcacgagacttgagctgggcctggaaccaaggggatgaggagggaagtgatgattggtgaagtaaaggtgttaagacttgcggactcatgaaacagctgatgagaaagggtgctgtctacagcgatgtccagaacagccctgggatcaacagggaaggaggagccgagaagcatccgagggaggtggctaaatgtgcagatctgtgcctcagagaaagggctggatataaagttgtgggaggcatcaggacagggtcaaggagagatcggattactcaggaatgtggaggggaagaactgggttctgggacagagctgtgggaggtgggaaagtcgaaggctcccaaaaaggacgatcagttagagatgaagcagggcatgcatcagaggacatcggagcaggcagaaattcaagaaaagggaacagcgtgtcctgagtactcaaactcacagagacagaaaagtagaatggtgactgctcggtggcaggagggggaagtggaaagtcgctgttcagtgggtacaaagtttcagttttgccagataaaaggagctctgcagtttggttttgcaacaatgtgaacacatttaacactgctgaactgtactctttaaaatggctaagatgacaaattttgtgctatgtgtattttctcacaatgaaaaaataaatctgaaaaagagagcagagaaaagggagaagccaaaagaaatactaggtctgttcgtgcaagatcttagtgactgggattggggggttgggagcaggaaggacccagacccaggggctgaggggtgagggagggtctcctctcccaatgctgaaccctgagctaatagaaggctcccatcacagccccagagggaagagggtctttcctacctgtgcctgtgccatttctgaagaagatgctgatggcgaggttctgtggagcatctgggatagaaagatacagcaccagcttcagaggtgacaagagggatgggcgtggtcccgggagggacccaaggaggggccacagaaacccaccaggtggggaccgctgtccttcctgcccacacacgagttttccctggttatcattctctttctctctctctcttctacacacacacacacacacacacacacacccccctcactcccactgcccttggggactcagctgtgtccccagcaccactcacaggagacattgagctggacagttctctccgtggtcacctgagctccttggcgtttcacctgacaggtgaggttggtgccatggtcctcgggcctgggggtgagggtgagctccgaggagcgggtggtctcggggtccagggggctgagggcattccccgtccaggagaatgtgagaggtggtcccgcttcacaggatcctggaaggctgcagctcagccttgtggggcggccggactccagaggctccagaaagtggatgtcgggtttctctatcagggctgaggaggagacagggagatacctgggccccaggggcttgaggacgtaaggtgtgaccccgagagtggccaggcctcaggccccgacctgccccaagtcctacacctcctccagccgcccctgcccaactcctgtccctgttctcatacgggggtctccacgtcccagggtcctctcctagggttcctgccatacctgtcacctccaagttcagcttattctgttggtagctatattttacatcccttcctctctccacgcggaagaaatagcttcccgtgtcctccattctggcatctccgatgctcagggagcagttcttcttctggacatccccaaggaggcggaatcggccctgggtctctggcttcactcttctgtctgggttgtttgtggccacaacctcagcgtagtatgggatctccccgtcccggaaccagtagacgtagagtgggggagaggaataccaggatctccaggggtaagagaaggagcagggcacaaggacgcacaggccctcctgcaccgtcaccgacttctgcacttgcagctcgtacactggcttctcctgcagggaccctggggggacacagaagctcagctgcagctccagccccccttctcacccctgtgcctgtccctcctccctcagctcactcacccccccacagcaggggcagcagcag

SEQ ID NO: 93 - DNA, 5001 bp, Homo sapiens
agcttcccaagtagctgggattacaagtgtctgccactaatgtcaagctaatttcttgtatttttagtagagatggggtttcaccatgttggccagcctggtctcaaactcctgacctcaggtgatgtactattgggattacaggcttgagacactgtgcccagcctatctttccactttttgatgtaaaaagttcttaattttgtgatagtcaaaatgtctaatcttttttaatggttaaatggctttttgtgtctcattcacttacattttctactaaaagttttaaagttttgtttctgacatgtaagtctttggtcctctggaatttaatgtttgtatatagagtgaagcaggaatataatttcattttgtttcctatatcaataaccattatttttctattctatttattgaaatgtcctttctttccttgttgatctgccatgtcacctacatcacatatcaaagattaaatttgtggagatttgtttgggaattctctattctgtttcattagtcagtttatcagtgaagaccactatttatttatttatttgtagagagagacagggtctcactttgttgcccaggcttgaggactgatgcaattgtagctcactgcagacttgaactcctgggctcaagaactcctcctacctcagcctcccaagtaactgggactctaaggcatgcaccacctcatccagctaatttaaaaaaaaattattattttttgtaatgatggggatcttgctatgctgcccaggctggtctcaaacttttgagctcaagcaatcctcccacctcaagctcccaaagtgctgggatcacaggagtgagccaccacacctggctccattttccatattttaagaccattttttaaaagctgctcaagactgcttttttctcttggtgctacttgcaactcccttacttagctttggaaatactcttaatgaagaaaatctaaagagttgaaaaataaaatattatttcttttcttccaattgcaaaagagcagacagcctcctgaattataaagttagttttgataaattggtgaactgagagcatacacagtattattaattctgttctaatttctgcttcactgtggagtgtcttcacatagtctcaaaagattattgctatgaaatattcttatacatgtaacacataacctctataattctgcagttgtacttggctgtcttacctaatactcagttgctttgcttcataatatttaaattggcatctttattttccaaaatgcataaatactagtatagatttttagttaagccagaagaaagtagactttatttactaacataacttatatgtaaaggtttaataaatctccctgcttctttagcatcataacaaccactgaaaataatatttctatagcagttgggggtaaatgggcaatgacttttgtggccagaggtgaatggcccaggggctcctgcacttcaggtcccactgagcctgccacacagctgagggcatcggtatttccacacacctacagtgcacgctgtcccagaacacagatcaaatgctctcctttattcaaatggggagttgagagtattgtcattgtaattaaattaataaatacatatttatacactgttaaaatctggttggatttgtgtcccttcacaaaacaaattgcttaaatgaaaccacagatttaacataaatgagtacatttgcttctacgagatgctcttttaaatggaattagaatctaatttgaaatgtcaattaaaagtttaaatattcaactcaattacatttagatttttgttttgttttgttttgagatggagtttagctcttgtcacccaggctggaatgcaatggcgcaatctcagatcactgcaagcaccttctcccaggttcaagcaattctcttgcctcaacctactgagtagctgggattacaggtgcctgccaccatgcctggctaatttttgtattttcagtagagatggggtttcaccatgttggccaggctggtcttgaactcctgagctcatgtgatccacccatcttggcctcccaaagtgctgggattacaggtgtgagccactgcgctcgacctttttagattattttactttattttagttacttatttttatgactttattgttataaaaatgctagctttttaaaaaaatcaatcaatataacaaagaacatagaagatgatcaacaagcattcccacctccatgatctggaaataactgtcattaatccaaaagcttacacatggtggatcccttcacaccagttcccagtacaaagtaactccttgcttgtagaaaacattattattatcattagtattttcgagacggaatttgagtcttgtagcccaggctggagagcaatggtccaatctcagctcactgcaacctctgcctcccaggatcaaagtattctcctgcctcagcctcccaagcagctgggattacaggcatgcaccaccatggcctgctaattttttgtatttttagtagagacagggtttcaccatgttggccaggctggtcttgaactcctgaccctcaggtgatccacttgcctcaaccttccaaagtgttgggattacaggcatgaaccaccacacctggaccagaaaacactattcaatagcaaacagtagcagtatgcttggcggttttaggattgattattttcaaatctctagaaaagttcaatgcattaccttaggctataatcccagggcagagtctcatctgttagtagggggctggtctaagggtccttccagctctcagattaatggtttcccatgttgaactgctccctgccacccacccatccttggttttgtttgtttgtttgtttttacagagacaaggtctcactatattgcccaggctggtcttcagctcctggcctcaagcgatcctcccgccttggcctcccaaagtgttggagttacagacgtgagcctctgtgctcagcccatccttggctgttcaaatgtggaggtaaattgtagatgccaagtttacctccaggtcagaaggggcagatgccccagggcagaatcataaccctaaccaggcctcccactgcatgaagcccttattttctgaagcttaaacctggacaaaggtctgaccagtagcactgtgttcatgaatgtcagctcaaaaatttaaaactgggactatccagaagaacctggtagatgcaggtgcagtctgcagtccaatggtcagccatgaaagaacaggctacctgttctttctctttaccatggaggccttgatgtaaaaatcgatgatgctttcttgcttctggtgtgcttccctttcttcttcattttccataagtagtttcctccatcccacctcccaacaggccacagtcaattcaggacattttaaccatgaaaatgagtctacataacatgaatttagaggccaggcagggtggctcatgtctctgggaggctgaagtgggagaatggcttgagcttaggagtttgagaccagcctgggcaacatggtgaaaccctgtctctaaccaaaaataaatgaataaaaaaaaataagtcatgtatggtggtgcatgctactagtccagctactcaggaagctgaggtgggaggattgcttgagtcaaggaggtcaagtctgaagtgggccaagatcatgccactgcaattcagcctgggcaacagagtgagaccttacctcaagaaaaaaaaaaaaaagatttaaaggacagactgactctcttattacaagccaatgctcatttgccgttccataaatcctagggcacctcttaagaattatgctaaatctactctacccgtgctctataaatggattcactattgtagacgccactaagaacattcatgattcaccagaggaggtaaaaatagcagcattaatgggagtttggaagaagttgattctaaccctcataaatgactttgaggggttcaagactttagcagaggaagtaaccacagatatggtgaagacagcaagagaactagtattaaaagtggagcatgaagatgtgagtgaattgctgcaatctttttttttttttttttttttttgagatagacttttgctcttgttgcccaggctggagtgcaatggtgtgatctcagctcacagcaacctccacctcctgggttcaagcgattctcctgcctcagcctcccgagtagctggtattgtaggcatgtgccacaacacccagctaattttgtatttttagtagagacggagtttcaccatattggtcaggctggtctcgagctcccaacgtcagatgatccacccgcctcagcctacaaaagtgctgggattacaggcatgagccaccgcaccggccagattgctgcaatcttaacggatgaggagttgcttattatgaatgagcaaagaaagtggtttcttgggatggaatctactcctggtgaagatgccgtgaacattgtggaaagaacaacaaaggacttagaatatgccacgaacttagttgatagaggagtggcagggtttgagaggattggttccagttttgatataaattctactgtgggtaaaatgctaccaaactgtacagcatgctacagtgaaatcttttgtgaaagcaagagtcagtcaacgcggcaaacttcattgtcatgttactttaagaaatcgccacaccctctccagccctcagcaaccattaccctgatcagtcagtagctatcaacactgagacaagaccatccaccagcaaaatgattatgacttgctgaaggcccagatgatggttagcattttttggcaatcaagtattttcaaagtaacgtacatacattatattttaaacataatgctattgcacactaattgactacagtagtttaaacacaactttcttttttgagatggagtctcactctgttgcccaggttggagtgcagtggt

SEQ ID NO: 94 - DNA, 5001 bp, Homo sapiens
tgattactggttatgtcaacatctagatcatgcagaagaacttgaaccgattttcattcctgccaatgccaggactcggtgggccaactatgaaaactgggtatgtgacagggtgtggcatccacaactgagaaaacaacatcactttacttcttcttttgatggattaattggacatggacaaacctctatggaagctcaaggtctgtcctgtgctcaggtagtcattaaatgaaggaaatttgctgggtatggtggctcaagcctgtaatctcaacactttggcaggcagaggtgggcagattgcttaagctcaggagttgagaccagcttgaccaacatggtgaaaccctatctctacacaaaacacacaaaaaattagtagagtgtggtggtgggcacctgtggtcccagctactcaggaggctgaggtggaagaatcgcttgagcccgggaggtggagaatgcagtgagctgtgatcacaccactgcacttcagcctgggcaacagagcaagaccctatcttaaaaaaaaagaaaatgttccctttgttttaaaaacaagtatagtgctgaatgatttataggtgacatagcaagatgatattacagttgaatcctgtgatttggttccacaggtggcatcctcaagcctcccatgaaggttatagaaggttctggcactgactcttatggtacaaacacttgtcatatcactggatgttacagtaagctcacaagccacccttgtataatatggggtagctcatctgctctcttcattaggctgccaaacactagacattaaatacgggtagaccaaaaatctggacaaacttggtcacataacaaaaccaagccacagacatgtcaaggccaaactgcaggcctcctatattagatattttgcaacccattctcctacagactgacaaagacacatggaagatggatgtgtgcagatgcctacatgataggtgacaagacaccagcccccaacctggtgggtcatgagttccactctgaacttatctgtgaacaacattggtctttttatcttatgtggcaacagattatataaaggttctcacctaaatggtcaggtcaatgtagaattggatacccaacaccttctatcaccaggtgtcactttaaatgtcagccaaattacaaacttgggctcttttatacacaaagtaataccacatgaacatactagatatgacatcagggaaaacccacttgtatgttacaattctaagttattttcagtattgagatccttttttccaggcgttggaaattatgtgacagaaagggcagttctaaatctttccataataatagaacaagagttcaatattactctgcaaaaattggtagcactcggccgggcgcggtggctcactcctgtaatcccagcactttgggaggccgaggcaggtggatcatgaggtcaggagatcgagaccatcctggctaacatggtgaaaccccgtctctcctaaaaatacaaaaaattagccaggcgtggttgcaggcacctgtagtcccagctactcgggaggctgaggtcagagaatggcctgaatccgggaggtggagcttgcattgagctgagatcacgccactgcactccagactgggtgacagagtgaaactccatctcaaaaaacaaacgaaaaaaaaattggtagcactccaattagaagttaatagtttaggaatttatggcccaggtaggggcagtctctcttggatcagcaagtcctcaggatgtcaaagcagtccgggcgcggtgatccacacctgaaatcctagcaccttgggagactgagatgggagactcacttaaggccagcactgggcaacatggcaagacaccagctctacaacaacaacaacaaaaaattaaaaattagatgggtgtggtggtacatgcctgtagttccagctgctcaggaggctgaggcaggaggatcactagagcccagaaggtcaaggctgcagtgagctataactgcaccactgactccagccttggtgacagagcgagaccctgtctcaaaaaacaaaacaaaatgtatgaatgaacctaggaaatcaatcaaccataataaaaagtttaattaaaagtaatggcaaatcaggcgttgtggctcacgcctgtaatctcagcactttgggaggccaaggcaagtggatcacttgaggccaggagttcaagaccagcctggccaacatggtgaaatcctgtctttactaaaaatacaaaaattagctgggcatggtggcctgcacctgtactcccagctacttgggaggttaaagcaggagaatcgcttgaagccaggaggtggaggttgcagtgaggtgagattgcgccactgcactccagcctgggtgacagagtgagaccctgtctcaaataaataaataaataaataaataaaataaaagtaatggcaaaaaccatgattacttttagaccaacctaatataattgcaccactgcactccagcctggcagagtgagaccctgtctctacaaaaatgtaaaataaacttaaaaaatgtcaaagcgtgataaagtacaggacataaagaccatgattaatctaacacccatcactccaatctttgcctctgttctggcattcccctatgtgtcttcgcatcaccctccttctgggtgactcctttatgttgtatttttttgttttgtttgggtttttttgttagtttgttttgagacagagtcttgctctgttgcccaggctggagtgtagtggtgtgatcttggctcactgttacctctgcctcccaagttcgtacctcagcctcccgagtagttgggattacaggcatgcgccaccatgccctgctaatttttgtatttttagtagagacggggttttgccatgttggccaggctggtctcagactcctggctcaagtgacctgcccacctcagcctcctaaagtgttgggaatacaggcataagccaccccgcccggccaccccactcattttgaatgtaagtagattaccaattctgaaatgggttttgagcagtagcaacattgacacaaatttataatattttcaagaagatacttccttcaatatgtaaaatgcaacagatatcatttgcaatcatacatatgtacatatatacatacacacatataatatatatatctcaccatggaataagtctgagctgaaacatgcattacttaaaaaagaaaaaacttacagacaggatcttgctctgtcatccaggctgaagtacagtggcacgattgtggctcactgcagccttgacctcctgggctcaagtgatcctcccacctcagcctcccaagtagctgggactacaggcatcagctacctcgcctggcctgcatgatctttatgaagaatgtcatagaaagtttttgaaagcgattaaagttgacctaaacaagcggggatctatgctgtatgccatgctattattggggaggaaaaaaattctcctctacattcctagggtctctggagatctgggcctaagaataaaactaagacagattagctctctccctctccctctccctctccctctccccatggtctccctctccccatggtctccctctccctctctttccaccgtctccctctcatgccgagccgaagctggactatactgctgccatctcggctcactgcaacctccctgcctgattctcctgcctcagcctgccgagtgcctgcaattgcaggcacgcaccgccacgcctgactggttttcgtatttttttggtggagacggggtttcgctgtgttggccgggctggtctccagctcctaaccacgagtgatccgccagcctcggcctcctgaggtgccgggattgcagacggagtctcgttcactcagtgctcaatggtgcccaggctggagtgcaatggcgtgatctcggcttgctacaacctccacctcccagccgcctgccttggcctcccaaagtgccgagattgcagcctctgcccggccgccaccccgtctgggaagtgaggagcgtctctgcctggccgcccatcgtctgggatgtgaggagcccctctgcctggctgcccagtctggaaagtgaggagcgtctctgccctgccgccatcccatctgggaagtgaggagcgcctcttcccggccgccatcacatctaggaagtgaggagcgtctctgcccggctgcccatcgtctgggatgtggggagtggctctgccccgccgccccgtctgggatgtgaggagcgcctctgcccggccgccaccccgtctgggaggtgaggagagtctctgcccggccgccccatctgagaagtgaggagaccctctgcctggcaaccgccccgtctgtgaagtgaggagcccctctgcccggcagccgccccgtccgggagggaggtgggggggtcagccccccgcccggccagccgccccgtccgggaggtgaggggcacctctgcccggccgcccctactgggaagtgaggagcccctctgcccggccaccaccccctctgggaggtgtgcccaacagctcattgagagcgggccaggatgacaatggcggctttgtggaatagaaaggggggaaaggtggggaaaagattgagaagtcggatggttgccgtgtctgtgtagagagaggtagacatgggagacttttcattttgttctgtactaagaaaggttcttctgccttgggatcctgttgatctgtgaccttacccccaaccctgtgctctctgaaacatgtgctgtgtccactcagggttaaatggattaagggcggtgcaagatgtgctttgttaaacagacgcttgaaggcagcatgctccttaagagtcatcaccactccctaatctcaagtacccagggacacaaacgctgcggaaggccgcagggtcctctgcctaggaaaaccagagacctttgttcacttgtttat

SEQ ID NO: 95 - DNA, 5001 bp, Homo sapiens
tctgctgaccttccctccactattgtcctatgaccctgccaaatccccctctgtgagaaacacccaagaatgatcaataataataaaaaaaaaaagacagattaacagaagaaaatcattcaagttttgctaaattttcagtgtacatgggtactttcacaagagaatgaaggcctaaagaagtcactaaagtagaaaaagtttctatcctttaaatagaaaaacaattttttttaagacaaggtcgggcacggtggctcacgcctgtaatcccagcactttgggaggccaaggcgggcagatcacgaggtcaggagatcgagaccaccctggctaactcggtgaaaccccgtctctactaaaaacacaaaaaaattagctgggcgcagtggcgggcacctgtagtcccagctactcgggaggctgaggcagaagaatggcatgaacccgggaggtggagcctgcagtgagcagagatcgtgccactacactccagcctgggtgacagagcaagactctgcctcaaaaaaaaaaaaaaaaaaaaaagacaagacaaagcggtttggattataggcagtaaattgtggagaagggactaggacatacatgcggagcaaaattggaagataaggattatttttagtcgtgtgtttatacagatccattggaaccttgattcacagtcacctgtgatgacaatgttcttctcttcctggtaaagggagggtgctttcttatgggaaattgtgtggcctattcttagatagaaaagggcaggtcagagagtctttcctgcatgtgctatttctcaagtgccttcaactcaaaataattaatactccaaagcagcatatttggggtgacgtgtctttaattccttcatttcccctgctgcagactttcctagaagtttcagatattaaaagctgagttggtggctatggagataagagccagattcataacgagggatctacaaatggggagaagaacatagataagaataggaatgaataagctgaaaggaacaggtctgagcacatttccccttatcctgttaaacacacatcccattgctgggacaaggtcagtacagcagaaggaatgcacctcttttgtttgatggagagtgtttagcttgttctttaacaggtgcagcttaggcactatttgtcccagtggatttacacagaccagccttatccaccaatgatcacacaaactcctccttttgaggctgtcagtgtgtccagggtgcaacaattttggaatacagcagaagctaagctattaacttcttttgttgtggttgctgttgttgttttgagacagaatctcactttgttgagtgcaggctggagtgcagtggtgcgatcatggctcgctgcatccctggcctcctgggctcaagtgatcctcccacctcagcccccagagtagctggaactactagtacaccctgctaatttttaaactttttgtagagacagtctcactatgttgtccaggctggcctcgaacttctgggctcaagtgatcctccctcctcagccttccaaagtgctgggattagaggcctcagccaccatgcccagattgctttgacatcttgaggccttagtgatccaagagagactgcccctccctgggccagctaattcctacagagaataaatgatttgcttatggtgtgccttcgatgggccaatcaaccgattcgtatctccaagataactttaccagccaccttccagcaggttcctgccccaaatcactccagggacaggtaccaggtaacaaaggaccactcctataacctagagcccatcacagttattgaaactagccaggcctaagtctgtttaccctgtcttgccttcttgcaaaaaacacagaaaaccctttgtccacctttcgccctcactcattctgccacctgactggccctggtgcttccccatggccctgcatggtgtggcgtgtcccccctatcatcttgggaactgtgagtaacaaactgtcttttaaatggctatcacctctgatctgtggcctcgccatacctgaataaagccaaaatcccgggtacattttaaaacaagtctacaagtcaaggaatgccggggtggttgacgtagtggcactcaggaaggcaagggcagtgcccctgaccggccccttctgcagcgcggccatcctttactacctgtgccgcaagtacagcgcaccatcgcactggtgcccgccagacccgcacgcacgtgcccgtgtggatgagttcgtggcttggcaacacacggcctttcagctgcccatgaagaagatagtctggctcaaggtgagcagggccacttctggggcttggggacacgggcacagggaagtcaggaaggctggaggccagttctggccctgctgactgccggcgacctcaagcaagtctccctccctctctgggcctcatttcctcagctccttctcctgcccgccttacagagccgtcaggagtgtggactgaaacaatgggcatgaaagagtcttattagggcgaggggaagggcatacgggaggggctgatgtgactcacccaggacagcattcgaggcatttcattctgaactagagaatctcagcgtcaaaaggcccacagaaggccgggtacggtggctcacaactgtaatcccagtactttgggaggccgaggcgggcggatcacttgaggtcaggagttcaagacctaccttgccaacattgtgaaacaccatctctactaaaaatacaaaactattagctgggtgtggtgatgggcacctgtaatcccagctactcaggacgctgaggcaggacaattgcttgaacccaggaggtggagttggcagtgagccaagattgtgccactgcactccagcctgggcgacagagtgagactccatctcaaaaaacaaaaacaaaaaagagtaaaggcctatagaaaattggaagatgacaaataaccagtacatgtgtctctactttgaattctatgcctgtgacagacatcactaatcaatcacaggacttatgcctgctgagctccccaaatccttgtgaacacatggttcccggcaacttccaccaatcagaactgctaaaagaggtgaaactgctttatatcctgggaagtgttcaatatctatccagcagacaagagtacagagacctggcagggcaggtggccctggagtgcagcctcctcttccctcctcttcccaaccctggccagttgctgatcccaaagataacaggggaggaagtttcagctgagaagatggagcatgcagtggaagaggtgaagaacagcctgcagctcttcgaggagaagtttctgcaggataagatgttcatcaccgggaaccaaatctcactggctgacttggtggccgtggtggagatgatgcaggtgtggagtgggttggaggaggggtagaccctgggcagaggtaggactcctctgtgaccaatggggccatcacttgaggataggctggtgaggtgggaaaggcaagcagagctgtcatgggggctgcgggagcgaggtctggggccctggactcaatctgggggcaacaggaagcacagaatgttatgaatcaggaaggatcacagttctccacacttgacaaagattcttcggtgtgggaggacctggagggtgagcctgggatagagaagaacactgcatttcctgctcaatccaccagcatcccagatacctcctcctcttgctggactctccaggaaatgttcactggcttcctgggtgtccttctggccctgcctgtttcccagagctccagacagacagctctggaggacagctctcgtggctgggtctgaggggcatccactgtgcatttggaggcacacctgagtgtggggcatttatgtggcctctacatgcaggggagggtgaccagttctgcttgtcaagacactggccagggtctcaactggccatcctgcacaccagctagggcactgcacactgaccaaagagactaatttgcatatcagccagagatatgcccgagaggagggacctggggtcctggtggattgaccagaaaatgcagtattcttttccttatcccagagatctctggctgatatgaaaattagtctccttggtctgtttgcagggcagaccagcaccaggaaaaatcattctggcctgccccaagggttcagccatatgcttcgtccccaccccttacatttcacccacacacacccattcttggccttcccaaagatcttgggtgcaaaccaaactacagggtacactcttagtgagccagccaaactgcagggtagactgcccgccaggtctcccatcttagcccctgagcttgatcacagtgggaggctaaacatggaggaaaaaacctgagttctctccctcatccacatatacacacctgggataaggggtttccctggaagaaggcaggattcatgcgagatcgcaggctggagaagtgggaggtgcctgggccaggagccctctcagcatggttcagaaggcttggagcaagaagaccggtgactaaggactctgagggattctggatcctccatccccacctacatctattacatagtctgtgaccccttgctcaggccttgggggtcagcagcctaattctttgcataggtacatgttgggcgcatgggcctgaggctgtgggagaggacacgggtgaggctggtccccagactgaccacgtctttgtcttcgtctatccacagcccatggcagccaactataatgtcttcctcaacagctccaagctagctgagtggcgtatgcgggtggagctcaatatcagctctggcctctttagggaggcccatgatcgactaatgcagttggccgactgggacttttcaacactggattcaatggtcaaggagaatatttctgagttgctgaagaagagcaggtgaccctaggcgcagcct

SEQ ID NO: 96 - DNA, 5001 bp, Homo sapiens
tgtcccgcagggcctggctggcttagcaatctgagccaccttccttaaaggaaatactaaaacaaaaacaaaaacaaaaacaaaaaactgttctttgcctaataaagaactggaacaaccatcacagctgctgagcagcagacagttggcatatgcatagggtctgatgtgggagtgggtggtggttacagatccttccagtttccaaaaagaattttaaaagtaaagggttaaatatggttacattgtgagtaataatagttggtgacttcaatactccactttcagtaatagaaaaactacagaagaccatcaaggaaatagggaatttgaaaagcacgattaaccaatcgcatacactagacatgaacagaacgttccacccgacaggagcagaataagcattcttctaaagagcacatggaatattctccagtatagagcatatatttggtcctaagtctcaaatttaagatgattgaaatcacacaaagtatgttctctggacacagtggaataaagtgaaaaatcaagaacagaaggaaaactagaaaattcacaagcacatagaaattaaacagcacactcttaaacaaacaatgggttaaagaagaaatcacaagggacatcaaaaagtatcttgagcgaataaaaatgaaaacacaacatgcccagatttataggatgcagcagaagcagtgctaagagcaaaatttatagctgtaaacacataagttaaagaacaacgatcttgaatcaataacctaactttacaccttaaggaactagaaaaataagagcaaacctaacccaacaccagtagaaaacaggaaataataaagattagaatggagataaatgaaatagaaaatagaaaagcaataaaatcaataaaaccaaaaattggatctttgcaaagatcaacaaaattggcaaacctttacttagaatagccaagtgaaaaaaataagggtcaaattattcaccaagaaagaaagtggaggctgggtgcaatggctcacacctgtaatcccagcactttggaaagcagaggcagaaggatcacttgaggccaggagattgagaccagcctgggtaacacaatgagacttttttctaaaaaatatatatttttaaaaaattagctgggtgtggtggtgcatgcctgtagtcttagctaactgggtggatgaggtgggaggatcactcgcgtccaagagttcaaggttacaccgagctatgattgcaccactgcactccagcctgagcaacatagaagaaccttatctcaaaaaacaaacaaaaacaaaaatgaagaaactaaaaggaaaccagaaagaaagaaaatggagacatcacattggtcatagagaaatacaaaagtttagaaagaaatactatgaataattatatgtggacaatttagacaacctagatgaaatgggaaaattttagaaacacacaatctaccaaaactgacttaagaaggaagataaaattgtaatagacctgtaacaaataaagagattaaaatattaattatttttaaaaattccacaaagaaaagcccaggaccagatggttttactggtgaattcaaccaaaagcttgaagaactaacacaaagccttcacaaactcttccaaaaaatagaacaggaagaaatatttttcaactcatactatgaggccagaattactctgataccaaagacagaaaaagacattacaagaaaataaagttacaaagcaatatccttataaatatagatgtaaaaatcctcacaaaatattagcaaatcaaatccagccgcatattaaaaggatcatacaccttgaccaggtaggatttatcccaggagtacaaatgcagttcaacatacaaaaatcaatcaatgtagcataccatgttaataaaaagtcacatgatcatcctaatgcagagaaggcatttgacaaaatctaacatccttttacgataaaattactcagcagatgaagatgagaaaggaacttcctcaacttggcaaaaagcatctatgaaaaacctataactaacaccacacttcactcattgtgaaagatggagcatttcccccctaagatcaggaacaggacaagaatgttcattcacactacttctacttattagggcaattaggcaagaaaaaggaacaaggtggaatctagatcagaaagaaagaagtaaaaccatctctattcacagatgacattataggaattcttaaggaactcacttaaccattagagctaataaacaagttcaaggctgggcacagtggctcacacctgtaatcccagcactttgggaggctgaggcaggcagatcatgaggtcaggagtttgagaccggcctgtccaatatggtgaaaccccgtctctactaaaaatacaaaaattagctgggcgtggtggcgcatgcctgtagtcccagctactcgggaggtggagacaggagaatcactagagcccaggaggtggaggttgcagtgtgccaagattgtgccactgctctccagcctgggtgaccgactgagattccatctcaataaaataaaataagttcagcaaggttgcaggatacaagattaatacacaaaaatcagtagtatacatttgcaataaaggatcaaaaacaaaattaaaaccacacttccatttataatggcatcaaaaagaataaaatagttagaataaatttaaccaaagaaaagcaacacttcaacacagcaaactacaatgtgctgttgaaagaaattaaagaagtgccaccaagcaatctgacctgagaaaacatgcaggttcaacagaatgagtcctgctcttcagcaagcacccatcttgtgttcaagctgggtctatgaggcaagtttggcaacatagacaaggacatgcaaccaaatctgtaatgtagaaaaggccaagggaaggtggatcaatcattggaaacattcaacaatccatggaagaaatgttaaaaatagaatctcagggtctgatgaagttggaatatcactcttctatgtatttcggttggaatctgttgaatgattggataaagtaaaagataagtatagggaattattaggtagcattaaatgtgtaataaatgtaaagagagggagcaagtgcatacaaggaagtgtgcgctactgggtttctgttgaattgttcatggaagaccatcagcagttcaaatccaaaagcctgtcttaaaattagctgagtgtggtggcgtgtgcctgtaattccagctacttgggaggctgaggcaggagaatcacttgaacccaggaagcggcgattgcagtgagccaagatcgcaccactgtactccagcctggtgatagagcgatactccgactcaaaaaaaaaaaaaacttgtcttgagggactatgccaggctttacagctacaaacatcatggaggaagctgtctgcccattagaagcccagagcccggagggacagactagagcaaatcctctccctcgttggagctagatgggaacacaaatctatctgataactaacatgcaattttacatctcttaccttgtttaatcctcacaaccaccctgatgagtagtagtattatccccattttgtagatgaagaaacaagttcttcaaggggaagggatcctcagagtagcatatgaatgagaggcagaaccagagtcaggacctatatcttgtcttctccttcctaaaactagaaaagtacccacaaccaggcaatgcttttggtgcagaaaaagcagtagtgaacaaaataggcaaaaatgtctgcctttagtgctcacattgttgtggagaaagacaaacaataagcacagtagagaagtaaaaattagaatgttttgctaaaaagtccataaaattgaatattattcagccataagaagggatgaagtaccgttatatgctacaacatggatgaaccttgacaccattatgctaaatgaaagaagccagtcataaaaggtcacatatttcattattccatttgaatgaaatctccagaataggcagctacttcctatccacagaggtagaaagtagatgaatggtaaccaggggctaggggaagaggggaatggggagtgactctttattgggtacagagtttcttttttgggtgatgaaaatgatctagaattagataactgtgatggtgacaaaactttgttaatatactaaaaaccactgaattggctttaaaccaattgaattttaaagtatactttgaaagggtggatattatggtatgggaattatatctgataatgaaaatatgattacattgttcaaaagcatagggaagcagctacaaaaaatatgaatcataaattgtggctctttttattctgaagtgtagaaattgaatattatagctcaaaatataaaacaaaaacaaagaaagctaaaagcccttccatttggccatcttggagtaagacctaccacagtccagtgccttttactcagccccacagcctagcctattgtttacatgaaaccctgtagcttccactcctgtttggtgggtgtaaagttatgagtgaccatattgggggaagggaggaaaactccccataaacgtgtatcctgggggcctaaggagagacgatggcccaggtatcagaacatgatatgcctacttgtccctatctccttgtccacacataaggcttggaaggcagccatgttgtatatcacgtgatctccaaccaatgagctgattggcttcttcaacaagagcccaggtagagattggtgtctagaggagcccatcagattctagagaatcaggcctttggcagtggaaactcccctgggaggatgtcatagggtcctcagggtcagacacagagagaaggagacattgggacagagagaagaggcaagaaaaaaacatatcttgcagtctgtgaggaacagagtggcccccaggggcctccacctcaggttctggatca

SEQ ID NO: 97 - DNA, 5001 bp, Homo sapiens
aaagctcctcaaagtttaaggtgcatttggatcacctgaggatcttatgaaaataaactctgtctgattcagtaggtctgggtttgggggtgggagcctgttagtatatttctaacaagctcccaggcaaggctgctactgctgctgatctaatgaccacagtttgaggctggacagagtggctcacacctgtaatcccaacactttgggaggacaaggcaggagggtctcttgagggtagaactttgagaccagcctgggcaacacagcaggacctcgtctctaaaaaacaagagagaagaagaaaaaggaaacaacaagaagactcaactagagtaggaagcagttaggccacatatctcttcaatggagaaaagagctttttcttgagtaaattggagtgtacccatgttccttgtcaatgatggtaactttaaatgtcaagaatgtgagagaggccaggggtggtggatcacacctataatcccagcactgtggggggctgaggtgggaggatcacttgagccaaggaattcgggagcaccctgggaaacaaagtgcgaccccgtctctacaaagtcaaaaaattagcccagactggtggcatgcgcatgtggtctgagctacatgggagggtgaggcagaaggattgtttgagcccaggttgaggctgcagtaagctaagtttgtaccactgcactcattccagcctgggcaacagcaagaccctgtctcgaaaaaaaaaaaaaaaaaagaatagtagagcccaggggaaggtgtggccctggggtaggcgctgggagactggagaacaactgttagtggtcccatcactgcccagagcagacagtgccctgtccaccctcatgagatctttgaactccttggacaggactggctataaatgaaaatgtggggacccttatttttaacttgttaagaatgttaagatggcaacagcaaagctttaaaccaagtgcatggcccttctgcgttgtaggcccacaaggccgacactgctattcacatccttgtatggtcccctaccctggagcgtggctggggcctgtgctctactgcttggaagcaaggcttatccctaagccttattttcgggaaggtggatttgagagctactatcccacatccttgcttggtgccctgtgaataaatcttttctcttttgcaaaactcgtgtcatggtgattaatttactgtgcaatgccaggcactgttggaaacctctggataggcctcacagggcctcagccatctcggggaggcgttagctagagtgtaacaaatatgaccccagcaactggggagggacagctcattccttcatgaggtgtggggctggcagccccgcaggcagtcagccacccttcctctctggcctccgtcctgggcactgggcccaggcactgggcaaggaggctgctgcacctcctttctcctcttcctttttttttattttttgagacggagtatggctctgccgcccaggctggagtgcagtggcgtgagctcggctcactgcaagctccgcctcccgggttcacgccattctcctgccccagcctcccgagtagctgggactacaggcgcccgccaccccgcccggctaattttttgtatttttagtagagacgggtttcaccgttttagccagtatggtctcgatctcctgacctcgtgatccgcccccctcggtatcccaaagtgctgggattacaggcgtgagccaccgcgcccagcctctcctcttcccttttagtgggaaatatacctgcagcctagattcccagaaaggggtggtgagagagcagacacgccactgattgacccgaagttctaggagccaagggatgagtgaagagggcgtggccggactcggggctcctggtgaggtgcaccgctgcaggctcggtgacccagcagttcctgcccaaccctcacctacccccagccgttcctgtccgccgcccccaaccagccattcctgcccgcagttcctgttcccgggcctgtccccgggtttgtccccagggcccgtcccctgggtttaggtctgccctcccacgccccaccccattgcccccgccatgggtctgctgtcccagccctgccgttcagtctacatcttcgccaagaatggcatccccttcgagcttcgcacagtggagctgaccaaagctgggctgggcaggcaggcccaggggatattggccgcggatccctgcctgtccccgctgctttgcagttgggccaagaatgcagactaacacgaagaatcagactctccggtgtggaaactattacataattatctatgttattatttttactttttggagacagcatctaactctgtcactcaggctggagtgcagtggcacaatcatggctcactgcagcctcgaccttccaggcttaagcgatcctcccgcctcagcccctcaagtagctgggactacaggtgcccaccgacatgcctggccaatttattattattattattattgagaggaggtcttgctgtgtttccgaggctggcctagaactcctgggctcaagtgatcctcttgccttggcctcccaaagtgttgggattacaagcatgagccgccatgccccactggttgtctattttaatagaggcttgatctttgcttgtgaatacaaaacattcttcaaaatacaggtttagagagggcacagcaggcacagaacgagggtagggaaatggagtggggcaagaatatcttcaccccatgtgcttggaaaaaacaatgaaactgcctcgttgtttcctaagtaaaatagtccctgtctacccctgcctgtgtctcttccacttttgtattatttgtttgtttatttatttatttatttatttatttatttatttatttatttattacagtgtctcaatctgcagcccaggctagagggcagtggcatgatcccggctcactgcagccttgacctctcaggatcaagtgatcctcccaacttactcctcctaagtagaatagttgggactacaggcacgtccccgtgcccagctacttttttctttggtgtgtgtagacgcatgattttgccatgtagaccaggctgaccttgaactcctgagctcaagtgatcctcctgcctcctccttctaaagtgttgagatcacagacatgcaccaccatgtctggccctgggtctcttccacttttatgtatttcttggcattcttctgccttttccttttcctgcatctgacttgctctatcccatggggcttctcacccagctgaaggggctactcctagaggctagaggctggagggccctgtggcagggcagtgggggaggccagcaccctcaccctgagctccagcgtttgctggtctggctggcatacagagatgcagctggagcacaattcagtggaggaggcagggctataactaagcagtagggcagagagcagagccagagccccctgggcaggccagagggaggaccctgctcagctgactcttcccaactgctgcccttggtacaaccagcttgagtcacctgctacagaacaggggctggacacagaagcagtctgtggagggagaatgggcaggggtgtgtatgtccattcagtagaagggcaaagaggcccacatgtaggcctatgatcagactggagcctggcttgactgaggtcctctgatccaaacaccaggcacctaatgcggcctctagcactggcctagagtgctaaagtgagtcagacctgggaacccccactggggagggagccttgagagtttggcataagaaagcaagaagagctgagccaccggaggctaagtagctgaatggggcagggattcccagcaagaatgaggttggtctgagggttgggaacatgtttggctgggactctggggtattgacaggtcacccagcctggccagtagggcctaagtccccagctgggataggaagctgaatcagagggggcaagcctagagcccagggaggaggctggaggggtctgacctatggatggaactggctgggggtggggtgtgaattacagctccagggaattgtccttgagccatgcttcaaggagctggacacaggaaagatggccctctgatggggtcaaggtctgtgacccagtgactagcagagaggcttcctcttccctgatgcctcccagataggggcctcagaaagctgctgctgggattttggggtgggggtgggcagagacctcagagaactctgggttatccccactcacctctctgatctttcctgcaggccagcagcacagcgatgcctttgcccaggtgaaccccctgaggaaggtgccgggccttgaaggatggggacttcaccttggctgagaggtaaccggtccgtgggctgctgccgggccttgtggggccagtcggctgtctgttcactgttgatggcttggatcatggactgtgggccctgcaccagccccagggtgaagaatgggtggaggcaggcagaggtgcccagtgttgacaagggttatagaagtcccctcctgcattgtacaagtgaggaaactgaggctggaggaggggagggacttgcacaaggccacagggcccagtctgcttccgggcctcctcaccgccagccttcccctccgaaaaaaggagagtgctaagtttcgaggagcggctgtaccaggcatcttagtgctaccattttgcccacaaatcctgtggggcaagtgctgtttccctggagagtcgagggaccactcagcgagcttcagtggctatttgctaaacatccaccagggccagaccccatttaagccctggggcttgagcagtgaacgtgtctgcgtccttctcctcatggatctcacattccattaatagaagggggagctgacagtaacccatgtaaacatggaacatatcggatgttgatggatgccatggaaaaaataaacagggt

SEQ ID NO: 98 - DNA, 5001 bp, Homo sapiens
taagagtgggggtgtgtgtcattatgagtaggatgctgagggaagactccctggaggaggtggcatctgagcagggagctgtaggaatgtgcaaggcatgaggagaagggtgttctcactggagggaagagtgagggcgaaggctccaggtgggacaatgcatggggttcagactggagagcaacgggccagggtgggtgcagtgagcaggaagagcaggaggtcacgacagaggggagcatgggacactgggaaggctttggctcttaccgcaggtggattgagttgttggagagttttgagcagaggagaactgtgatctgacttacgtcgtaaaggatccccctggcaggggtgagaaagccactgcagtcatctggcatgcagcgctggagccccagaccaaggtggtggtggtgcagggttgcgggggattgtggtcagttctgacttttattgaaatctaactgcagggtttgctgaagggttggaggtgggtgggaaaaatgaaagccaaaaccagcctccaggttggtggccgcatggtggcgtcctttaccgaggccacatagtgcctccttggtggagctggattcacattcagagcctgggatcactggatggtccaacacccataaaggcatgatgagctctgagggtcagactgcacaacccttcaccataggtgaacgggagttgggacagggtgggaagcaatgctgccatgtcacctggaaggctctgtccctgctggccttgctcctggccctgtccacactttggatatgttggggagatatccaacatgctctcgttcttcagactcacactgggtgccccttcctcctggaagccttccctgagcccctgctgaagttcatgacattttgtttcttccttgctgcccttagttgagatgacagtctggccccgtgtagggctgtgtgaccctgggtagttacctaacctctctgagcctcacatccctcctctgcatcatggggatagtgaaaatgccccagaaaacggttgaagagtgttcagggcatgtcttctgcccctgccatgtccccccagtgtggctagcttgctctatatgagctgcatgtacaaagcacctgaccactggtacctccaggacctgcaggcccgcgcccatggggatcagtacctgtcatggcagcacatggccctgcagagtagctgctgctgggccatgtggcagacggtgagccatggagggcagggacacctcccgggatgcccaagggatgctgctttcactttacaaaattctgtttagacctgagaccaaatcctggaatgccagagactgcctaattcacccaacttgtttcataggagggaaaccaaggaccagagccaaggaaggattcccctaatgtgccttaattccacagctaccacctgcacacttacactcacacactgttcgacacacagccacactcacacacacatccacccacgtccacccacagtcacacgatgtatcacattcacacgtatacacccacacacacaatcataacatttacacacagtcacacagttaactcctatacacacatatacacccacacaatcacacaactcactcatattcaacaaagtcacacaactcactcacattgacacacatacacaccaaccccacacacaattcacatacatacacacacatatacacccacatacacaaccacaccattcactgacattaatacaaagtcatcacacagttcactcccacacacacacatacacctcacacacacaggcacacaattcacaccaacaaaatcacacagttcactcattcacacacatacacccacatacacaaattcacactgctcagtcacatttacacaccattcaaattcacacacatatacacctacatacacacagttcactcacatcacacacatatacacccacatacacacagttcactcacatcacacacatatacacccacacataaacacagtcacacaattcactcacgttcacacacacagttcactgacattcgcacacatacacacacaccacacacaggcaattcagtcacatggccgaaagccagtccttaccttcctatagttcctttcccagtgtcacctcagcctttggccctcagcgtccccttcccatgcctggactgcggaagagccctgaacacaccccatcttcatgcctccagcgctagcccgagcccttccctctgccaagagcactaagtgcaactcaagatcacttctagggacccttccctgcccctgctgccaggtgacctgaggatcctgctggtcccgcttgacaatgatgcacagcatggttagttcagctgaggtcgctctcccagacttactgccacctacacagcactaggactgactgtttaactttattctttatttcgtgtactttattggagtgtctgttgaaagcaaaaccatccaataaggaacaatcccaaggcagccagcatggatcaagaaggcacaggctgtggccgccatccccagtgcctgatggggagagggggtggtaatggaaaaggcccaggaaagcaggccagagtgtccctcaaaatatgagaaatcactggaagagagagccagaatgggacctaagacagaagccaccaccaggcacccttaaggcaggacagttgcaatggttacttggaatacttccggctaggagtggtgttgcgggaagtcagggaccccaaacagagggaccggctgaagccatgacagaaaaacgtggattgtgaagattttatggacatttattagttccccaaattaatacttttataatttcttatacctgtctttactgcaatctctaaacataaattgtaaagatttcatggacacttatcacttccccaatcaataccgttgtgatttcctatgcctgtctttactttaatctcttaatcctgtcaaccaaggaggatgtatatggcctcaggaccctgtaataattgcattaactgcacacattgtacaggatgtgtgtttgagcaatatgaaatgtgggcaccttgaaaaaagaacaggataacagcaattgttcagggaataagagagataaccttaaactctgactgctggtgagccaggcggaacagagccacatttctcttctttcaaaagcaaataggagaaatatcgctgaattctttttctcagcatggaacgtccctgagaaagagaatacgcaccaggaggtatcagcttataaacagcacccctgggcgtggcctgtctcttatggtcgagactgcagagatgaaatatactccagtctcccatagcactcccaggcttattaggaagaggaaattcccacctaataaattttggtcagaccagttggtctcaaaaccctgtctcctgataagatgttatcaatgacaatggtgcccgaaacttcattagcaattttaattttgcctcggtcctgtggtcctgtgatcttgccctgcctccacttgccttgtgatattctattaccctcttaagtacttgatgtctgtcactcacacctgttcgcacactccctccccttttgaaaatccctaataaaaacttgctggtttttgtggcttgtggggcatcacggatcctaccaacgtgtgacgtctcccccggatgcccagctttacaatttctctcttttgtactctctccctttatttctcaagccggctgacggttaggaaaaataggaaagaacctacgtgattattggggcaggtcccccgatagagtggcacatgatgggcacagggcaggcttgggaaatggggggccgtaaggccacaagacatgtgggcaggtagcccagagtgtgtctggaacatcctgtttattggtcggcagtgacatctactgtcacatttgagaactgcatccacagccacatgacctcctgtgaagacctcagggcaaactggggaaacctgcccttcttggaaggtgatactaggggggatgagcaacacctttcttggaggtttgaattcttcagggcccctccagcatcttggtcttcctaattcctcccttgatcccccagccctaggggtggtagcttcttgcagtgtttacctccgtgttaatctggattctctctgtcttcggagttctctaatgcctggttaccaattctttatatcaagttctctccgttaaaatcattgtggtggggtccatcccatggatatacatggaggtctgtgtgacaatgtataatcttactatttgcagttattacaaaactgtcctagaagacatgaatgcttgttaaaagaaatcttttaagtttcctagacttcaaagaccgttgctatgccctgtgaaacatcgcctatatcctttaacagtttgcaattcgaattggttacttacttaacattttgttgccctggtgatacaattatgttgactcgttattgtgaggttactttgttattaaccatgatgaggattactagcacatacttttactccatatgtataacacaacaatgtagtaaaaccaataactcttggttctctattcaaagtgtttggaatctttattctgtttaaaacactgatgacatttgccaatttttgagtgttcttcatgttactgatttgtaggagctctttatatattgcagatttagtctcttactggttatgtatgctgcacctgaggagtagcagcactgccaaggacactgagtgtcttgtctgtgcagagcttcacatgaagctggagagaagggactggggcaagagggaaagataaaaaggggcaagtaagtaacagaatgaatccttgttgctaatctcctggcccccatcccagacccttcaggggatcctggcgattcgaagcagcatagcctgataggcctctggtgagggtgttgggagggttttcttggccgcctgttccaggatg

SEQ ID NO: 99 - DNA, 5001 bp, Homo sapiens
gctcaagatgatgctgtgggcctcctggcatagctcagcacccaggaaagcctccactcgtccacgccatgctgccagtcgtggccgtccctcaaacagttcatagccgagagccaccggctgtagggacaaggatgaaaaagttgtgggcatacaactttcccagttgtcactgccgacccgaatgctggaaccatgggcagaagtatcagagacatggtccattccccagcccctaagtgaatggaccacaggggcccaggcagtatgttcagccttagagcccaagagcagccagggtgagaccccacacccaggcaggaggcagaagttcagggttctggccccagatcatccagagacttgctctatgattctgggcaaagttctggctttctccaggcctcagtgtttctgtctgcctcatgggtgtgacacgaagagggacactgcccacaggctgagctcacacctgcatcagctcctccagggccatgagatcagccagtgtcacctgctggccagcgaggaagggcctgtcccccaggaacttgtcctccagccattgcagggcctggtccatggcagtcctgttgcgttccaccttctcctcgggcacctggaccccaatgaggggccccaacacctgatgggggcagagagtgggtcagtctatggccccggcctactgccaactactccctgatggccaatcactctccagatggctctcctcacctggacccacaggggtataccaaaggtgccacggatgcagtcggcatgccagcccaggtactcatgaacacgggcacgagcctgcaggtcagatggataccagtggtccggcgtctggtacttacagctcaggtaaatcaggatggccgagctgggaacaaatgggcagtggctataaggacactggcaccaggcatttacccctaactgctcccatctgccagtggggcccgggggcttctctgcatttgaaggactgccctccagcctcgccctccatctccagctccccaacaccaccccctcctcctacgagtctcctcctgtctttgttgccttgggcaccgactcttggctggaccttctgctttgcattttgagaacctcatctctgtgatatgccagcagccgccctgtgaggtagacactcctgttagccttttagcacaagagaaaactcaaggtcagaatggtcaagtgacttgtccgaggcggtgcagctcagaataggctccctggacccctggaaccctgcatggggctggcacacagtggatgctccgtggagtcccttgcatgtccacgcgcttgggtcagggatcacgaggggaggaatgtctttggcccccgtctgacaggcccccagccatcacttctgcagccacctgacctcttgtccttttcctgcccagcagctggacctcaccatgagctgtgcccttgggccatggcattggcctctaggcccggcctgggtagattgggtagtctgcgacaagtcactagaggctcttttcagctagcatttgttgaacaaatgcgcaacagtggaaaaatgttcccttgtcttctcttctaatacccttcagtctgggagtggagaggccctgcggctcagaaaaggctggaagatgagaggtggggggacatgttctgtcagcccctgctcatcccggtcacaccccaagctgtaccttctccccagatacctctcctttctttctttcctttttttttgagacggagtctccctctgtcgcccaggctggagtgggctccctctgtcacccaggctggagtgcagtggtgctatctctgctcattgcaagctccgcctcctgggttcacgccattctcctgcctcagcctccccagtagctgggactacaggcggccgccaccacgccctgctaatgttttgtatttttagtagagacagggtttcaccgtgttacccaggatggtctcgatctcctgacctcgtgatccgcccacctcggcctcccaaagtgctgggattacaggcgtaaaccaccgcgcccggcctttttgagacggagtctagctctgtcgcccaggctggagtgcagtggcgcgatctcagcacactgcaagctccgcctcctgggttcacaccattctcctgcctcagcctccagagtagctgggactacaggcgcccgccaccacgcccggttaactttttttccatttttagtagagacggtgtttcacggtgttagccaggatggtctcggtctcctgacctcgtgatccgcccgccttggcctcccgaagtgccgggatgacaggcgtgagccaccgcgcccggccagatccctcgcctttcccctccctcgctgccccatggggtatgggagggccactggggcccggggccagtggggagagccaaggtcacatgggctccggatgcggtgaggggtgagggaaggagggcacctttcagtcaagatgaaatcaccatccttgagcgtcggcagtttccccaggctgttgatctgcaagaactccttgctcttgtgctgccctgaagaggaagaagtcagaaaaggtcttcagaataaaaacgctgcacctctacaccctccctcctcctccccaagcggagccccacagccctgagaaacagcaaggtctgggactagaggcctggatcagcctcactccctggctgggcctccctgccctgccacattccggggcagctggggggttttggtgggtggggccaggtgcagcaggtggataaagagaagttttctagccggactctggtgggccaggggaggggaggcaaactggggtggctcatctcttcccatctcttaattctcacaacagtatgtccttcttcccgaggtcttctgggctttgtgaatttatatgcgtgcattccacgcaagaactctgtcaactccattcagtattttctttccatccctacagagcagaaggtaacgttatcctccttttcagaaggcaagctaaggttcagagaggctgtgatcccttcaaggccactcagtccacagcattctctggtggcagacgctgcaggaggaggtgagggggctgtgcgggcggcgagacgctcagggcagagcagggcgggggcctgggggtgcactgggtttgtggacacgcggggaaacgggctgggcccacctttgaccaaatccacggtgcgcagctctaaggggatgccattcttcttggcgaagatgtagacggcgcggctgggctgggacaccaggtcaagaaacagctctaggcccatggcgggggcggcaaggacagcggggatggcagtgaaggcgctgagcgcggtgtgggcagcagctgtggcaggatcccggcgcgccgggaaataggggatcaggccccaccccctggggacagcacccaattggagcgcaccacccccggacccgcctcgccccttcggttcctgtccagtcctgccggccaagactccaccaccagatccgtgcgtccctacagggagggcggtcgctatgaacgcacagctgggagggtggagttggagctggggaccctcgactggcagggaggacgcggatgcagggggccgactgcaaggggaaggggaaccggctggacagggagaagcaggtctgcttttcgggatcccggtgccagggaccctgcccagttccaggcgtcgccctgacccagaaacgactgggcgccgccgtcctggaaaggccccagcgcacggacatctgagggttcgttcagagctctgtttctcggcgctgcatggtggcggaagggagggagcgaatgggatcccctaaaagggatcttagagtttcacccagtgggatgtgacacttgcaggtgtcccaaactggtgggaaccttgactggaaggctggggttaaggatgaactttctgccgtccagactgtcccctgcagagcagctgctgccagacagcgggagctgccagacagcgggagctcccacttcgtgcacaggatgggggcagggagcccgcagccgcgggaggcaggaatgactgtccgggaacctcctttcttctccctgaatcccagccctggcatctcaccagggggcacagtgatggtccagggctgggcccgggactctagctgaatctttcagagtatcccatccctctggccagtggcccaagcgagtgaaccagaatgcttccttgggagttttgaaactggaactggagagaggagctccctatggggaggtaaacgggagctggggccacctgtagtgacatttcctgagttcgaggagtagacgagactgagagagaaaagctgactcagagaaagggagtgataacagggcatgctggcccacacctgcaatcccagttactctcacgggatctgtttctctgatgtctgggtatgaaaggactttctaagcctcagaacagtgggagaactcaacaaagaaaaaaccaatacatatacaaggttactttgtggaggaaaaaatggattaaccttaagcaaaaaactgggaaggatctcggtaaaagatacgtcagaaggaagtaatgtcctttaagatgttcttagaaacccatcagacaggtggggtgtggtggttcacgcctgtaatccctgtactttgggaggcagagatgggcggatcagttgaggtcaggagtttgagaccagcctgggcaacacggtgaagccccgtctctactaaaaatacaaaaattagctgggtgcggtggcacactcgggaggctgagacaggagaatcacttgaaccttggaggcagaggtttcagtgagctgagatcataccactgcactccagccgggccactgagcgagactgtctcaaaacaaacaaacgaacaaacaaaaagaagagaaactcatcagacgaagacacaggaaaaaaatgagcgaaggaaatcagcagaggtttcattga

SEQ ID NO: 100 - DNA, 5001 bp, Homo sapiens
aaggacaaagagaaatggtcaatacatggatgaaaacatgtttaacttcagtaataatcaaggaagcacacaccaacacaacatgcacatactgtttttatttatcaaaggcacacatatttttgaaatgagtactcctaattaatatgtacagagcacttacccagtgcccagcacaggggtggcaccctgtgtgtgagacagcatgaaacaggtagacacgcgccctgctgaaagtaagggaccgcctctctggaggatccatcgggcaataaggaggtttccacaccttaactgtgtctgccttgacctctggggcctgggagcagagccccctccagctggtggggaaggaagcgtggtgtgtttgaggacagaatggagagaagttgagtagagcaagtgtagactcttcctatccaaagtgtggtcaatggactgggagtatcagcatcaccagggagcttgttggaaatgcagaggctcaggccccactctgaccttactgattgggagcataaactgtaaccagattccagggaggattcatacacacattcccgtttgataagtggggggtagtaggaggtgaggtgaaaagtggggaggggatggctaccgcactggagaaggctggctttgtgttgaggcctttctcatgagggcagtggggagccatggaaggctttatgcaagagagggtacgggcagattgagattacagaaggatcccactggttgccttgtgtgaggacccagggagaagggggaggctgtccctgtttgagtaggagatgagagctactggtggctatgagtggaaagaagtgagcagaggtgagcagaaatcccaaggactggtgatgataggatgatggtgggaaccaggatgggctttgggcagaccctgacccctctctctgcctgtcggcccaccagataataatccctgtgttcctgggcgagtcagtgccacccgagatgttggcggccactttggctgagctggacggatgcctgcagctgctcgaggacaagttcctgcgggaccaggccttccttactgggccccgtatctctgtggctggcttggtggcaatcacggagctgaggcatgagagtgccatggggtgcggtggcccgctgggcagtggtgtatccgggaagggagctgacatcccagctcatgttgtcttttctggctgtgggaccctgtgtgagtcacttctccttctgagcctcagtgtcctcatctataaaatggggctttacaaacccctcaccgcagctatattaagaggcttccaagtgtccccagggagggggacatcctagcccatcacacacatggtggaggagggaaaatccaatcagagaacccctaaagcaggtcatgctgccttacacttggctatgcccagcccctccgctgactctgtcttcccctagcccatcagtgctggctgctgagtctttgaaagcggacccacggtggcagcatggtgcccaacacgtggaggctgcagtgcgggaggacctcttccaggaggccctcccagctgtcctgaaggccaaggacctgcctccagtagaacctgctgttaaagagaatctgaagaccttaatgcagcttttcttgctgtgagtgcgtgtcccacacttgctgagccactgaggggatgctgtgttggtagaataaagacatggagctgtccgtctccttggttgaagagaagacatatctgcaaaggctctggtccacagttcctccagatatcatgcctgcattccttttgtctcctaccccattccattctagcttccatgtgacctctgaaaagagcttgggcaaacgcttacttgaccctgaccttctgtgtggaactttgtatggttcctcactgcccagaagctaaagtacaagtcattgaactttgcattcaaggccttgctcccactcctccaggtggccccttctgcctgcacactcctaacccctctctgggctcccaccttggcctcttggcctccgctcatgctgttccctcctcatcttcgcctggtgcccttcctggtcttttggcatttggcaccctgtctcttctccagggagacttccctgacctccccagccccagtccaggtcaggcgacctctctgggctcctcagccccagtgtttccttgcgggggatacccccggactgagcatgtatcatcgatgaggggtgacctggtggaaagatgtctgaatcaggatcagccttggtctcctcggtctctctcctcactgtggggcgatgttgtgttccacaagtggggtgcagggctggttcatgaacctccttgcaggaagggaagtccctggttatttcctggccctctcccatgcctcctcataaccttgaccacagtcttctctacaccccactcccggaccactggcttgtccatgccccacacctggtcccagacttgccacctgtccctgccctctccccttaggactgtcatatttacctgtcgtgtgtctcagaccttctgatatctgagtcatctaataaacaaactgctaataggacaagatcatgacagacagagactctgtcggcctttcagtggaggctcctttaagtatgcacacttatagagaattttatacacgtagttgaaattgtacatataaacttgcaaattttttctttcttttttgtgggggaggggggagcctgggtctcactctgtcatctagggtggagtgcagtggcacagtcatagctccctgcagcctagatctcctgcgctcaagcaatcctcctgcctcagccgcccaggtagctaggactacaggcacacaccacagcacccagatttctttctttttttttttttttttgtagaaaataaagaagagaatcttgctatgttgcctagcctgatctttaactcctgggctcaagcaatcctcccttcttagcctcccaaagtgctgagattacaggtgtgagccacattgctcgaccacaacttcagtcatatttgtaatgtacaattcaagtgattttgccacactgaccacactcatgtttaagccacgccaacagagttccatgttttctgatgttttttcgagatggagtctcgctctgtcacccaggctggagtgcaatggcgcgatctcggctcactgcaacctccacctccccggttcaagcgattctcctgcctcagcctcccgagcagctgggattacaacgtctgccaccacgcccggctaatttttgtatctttagtagagacggggtttcgtcatgttggccaggctggtctcaaactcctgacctcaggtgatccgcccgcctggacctcgcaaagtgctgggattacaggcgtgagctaccgtgcccggcctttccatgttttaaagaacatattttgccaccccctggtggacagtggctcaccaccggcacaagaggctacacaggcagatgtcaatggggaccaggcagggacaggtattgtcgtgagcctagccctacccgcgcccccgcgagtaaccacatctcctgactgcccaagcgcagatttccatactgaacatgaaattgcctgacttcgaaatggtggcaaatcattcaaaaaaactttaagctcccgttgtattggttattagggtcgagcctggggaagacccctataggtgtgtgtgtgtccttgtgtgtcgggggtgtggtgttcagacctctaatagggctaggaaccgggcgaccacagcgcggaagcttgagagggaaacccacctggcgccaggcaggagggtcgggggagacagggtgggtccactaccgggttaaagacctgtagtgggtggggctacacgtagggcggagacgatgggacttccggaaatcagccggcacacgtgacttttgtttgcagaagcgggaggtaccctaggcagccaatcggggagcgccgagtctctgtccagccaatgagaagccaggttgctgtggcgcctcgcccctcctccctggtccgcgagccttgggtacccccagcttttcttccgccagagctgtttccgttcctctgcccgccatgccgttcctggagctggacacgaatttgcccgccaaccgagtgcccgcggggctggagaaacgactctgcgccgccgctgcctccatcctgggcaaacctgcggacgtaagcgtgggccgggcagcacggggcgaggggaggttggtgggccaggggtccggccctgtccctgctccgcctccccgacagtgaccccgaatcttttccccagggaccactccccactcctttcctcacgccaagctctgactttccgtgctccacgatcccgcggctccccctccgcacgtctttcccttgtcgccctccccagtcatgacccgggcgtgaccttcagggaccgcggcccgtatcgggatccctgccccgcgaacactgcgcgtttcggctttcgcgcgctcgggtcccgtccccagaggtagcccggccggctccaacttcgggcaaaacttttcatgtccccctcagcgcgtgaacgtgacggtacggccgggcctggccatggcgctgagcgggtccaccgagccctgcgcgcagctgtccatctcctccatcggcgtagtgggcaccgccgaggacaaccgcagccacagcgcccacttctttgagtttctcaccaaggagctagccctgggccaggaccggtgcgtaggggtagtaggggatccatgtgggactgccgcagactggagccactgatcctgcctcagggggaaaaacccatttcttgccctgcccagtaaggacacatcagggtctggagctttggggccccctgaccccttaggttcctgctgttaggaccatcttcaaagtgcgagcaggattgaatgaatttctggctctgctcctcagtgtgtaagtctgtgaaccgggaaggctctcttttaacacc

SEQ ID NO: 101 - DNA, 5001 bp, Homo sapiens
ccccggggcagtgcaagggtcatgtgggattgtctgtgtgctgtacctgccttggcacctgacagggtaggtacacgtggctgaagtgtgattttctagaacttttccaggctggtcagaaggaattctgggtatgttctgaagttacgtattttggacctgtgtcccagccaggttccaggtgaagttcacgggagactcacagagtagtgaaagaccattggcctggatgtctagacatctgctttctgggtcctgcatagctgggggaccccagacaaacttggaaatgaaccatctccagttggcaacctcctcttctgtgaatacaggggaaaagacctccctcccccacaagaagcgtctgcaacccaaacctggcgttctgtgaccgagttaaagtttcctcttgggtaaaagatattcttgagccacatccatgtctaggaggaagtaagggcatgagaagcttgaaaggacactgtccaggcacggtggctcatgcctgtaatcccagcactttgggagaccaaggcgggaggttcatttgacccaggagttgtagaccagtctgggtaacatagtgagatgccatcccccaaaacagttttaaaaattaaccggacatggtggtgtgcacatgtagtctcacttagttggcaggctgaagtgggaggatggtttcagcccaggaggttgaggctgcagtgagctatgattgcgcattgcactccatcctgtgtgacagtgagaccttggctcacaaaaaaagaccttctgaaatggagcctttgttagtccatgaaggtcgatgaggaatggctgatcctgctgggtcctccctcaagctacagaggaataatacagtcagccccctgtatcactgggttacgcatctgttgattcaaacaaccatggattgaaatattagaggaaaaaaaattgataattgcatctatactgaaaatacgtatagactttattccttgtcattattccctaaacaatacaactatttacatagtacgtacattatattaggtattataagtaacccagagattatttaaagtatatgagaggatgtgtgtaggttacatgcaaatattacaccattttatgtaagggacttgagcaaatgtagattctggtttcctctggggattctagaacaaatctcccacggatactcagggaaaactgttactctaacaacaagtgttatacacttaccatgtgctaggtcctctacaggtactttacactcatgatcccatttgatccttacaatccctatccactctccctttgctcagacaagacatgctatccccatgaggtagataatctccattatgccaattttatgatgagaagactaaggctcttcatactcccccgccctcagccaggctgtcccaagctgtggcgctcctcactgaaaactgctgtcacctctgagaggggcatgttggcttatggcacagacattagtggtgggggggccaccctgtgcccaacctttgagaaaacaggtgtctgaggtactgtgtccttagggagtctgcaattaggaggaggcagattgcccctcagcccacagactgacagagatgatggagtgtgcagcacacacgatgaggctactgtgttgagtgtctgtcctaggtgggtcatgctgatgtgcagccaccattccacacctgagtgtcccactgccctgctgggggttggggaatgctcattaccgggatgagcacttttgcaaaatgggctgaggtgggaggatcacttaagcccaggaattcaagaccaccctgggaaacaaagtgcgaccccatctctacaaagtcatacaattagcccagcatggtggcatgagcctgtgatccaaactacatgggaggctgaggcagaaggtttgtttaggcccaggaggtcgaggctgcaataatctgagtttccaccactgcactcactccatgctggctgcctttggattgttcctaattggatggttttgctttcaacagacactccaataaagtacacgaaataaagaataaagttaaacagtcagtcccagtgctgtgtaggtggcagtaagtctgggagagcgacctcggctgaactaactgtggtgtgcatcattgttaagcagggccagcaggatcctcatgtcacctggcaggaggagggacagggaagggtccctagaagtgaccttgagttgcacttagtgctcttggcagagggaagggcttgggctagtgctggaggcatgaagatggggtgtgttcagggctctccagcagtccaggcatgggaaggggacgctgagggccaaaggcggaggtgacactgggaagggaactagcaaggtgaggactggcttttggccatgtgactgaattgcctgtgtggtgcgtgtgtatgtgtgcgaatgtcagtgaactgtgtgtgagtgaattgtgtgtttatgtgtgggtgtatatgtgtgtgatgtgagtgaactgtgtacatgggtgtatacgtgaattttagtgaattgtgtgtaaatgtgagcagtgtgaatttgagtatgtgggtggataagtgaattgtgattttgttggtgtgaattgtgtgcctgtgtgtgacggggagtatgtgtgtgtgtgagtgaactgtgtgatgactatgaatgtcagtgaatgctgtgattgtgtgtgtgtgtgtacgtgtgtggggatttggtctatatgtgtgaatttgagttgtgtgactttgttggatgtgagtgaattatgtgactgggtgtatatgtgtgtgtacacgagttaactgtgtgtaaatggtatgattgtatatgtgtgtgaatgtgatgaatcgtgactagatgcgggtggatgtgtgtatgtgcatggtgtgtccatgagtgtgtaagtgtgcaggtggcacagttgcaacaggagagaagacacaggaagccttacctgccattcatccccccagctgtcctcccagcctggggacccctgggctggaaaggttatgaaaagtggtgctactgccaggaaggggtgatggggcagctgggaggacggtttgagtcttgccaaagggagggagtcgaagcttgcaaccctggggaggaggaggggcagactggggaccctgcttctggaaaaccagcgaccaacccccaaagggacacaggcaacccctgcctccactctacagtggggaaaaggggagagtggcgtggcaggctgcccagccagtcatggagggagtagacttcaggaggagtacagaggtctggtcccattttggggctgaggacaggagcctcaggtcagcagtctgcaggaaggccccagctggaccagctgctcacaccttcccacaggcctgcagatgggtgtggagagcagagcctccaggctgagtctcccagccccagatctgagcagtctaaatcatccccctccaggttccctacggtcttatccaccagccctgctgcccatggtggccccagatgcccaggagagataatagaaggtaagaagtcatgtttgaatgaggaagctctcttcatttatttcatatgaggatgaagaagaggattatgtgatcacaggaatgttgcatgcgggataatccaaagctggttatctccaggccctcactctgccaagagatctctctggaagaagcagccagttcacagatgccctggatccctccgtgcccaatcataaaaaagtcatgaccgtccctatcttgccaatctgccaggactccaaggggaaaaagcggataagtatccttcaggagacagagaaaaagatatcatcagctccttggctaataccacatcttgcaagacccctgccaggtactcccactgtgggtactcaggacagcctgcctcagtccaccaggcattttgcaaacctgctcatcccaataatgattttccccaacccccagcagggcagtgggacactcaggtgtgggaggtagccgcacatcatgacccagctaggacagacacacaatacagtagcctcggtgtgtgtgccgtacactctatcatctccatcagtttgtgtactgaggggtaccctgcctcctaattgcaggctccctaagggcacagtacctcagccacctgttttctcaaaggctgagcacagggtgaccccccaccccaccaaccccgccactaatgtctgggccataagtgaacatgcccctctcagaggtaacagcaagtttccagtgaggaaaaccagaacttgggacagcctggttggggcgggcgggagtatgaacagcctgtcttctcatcataaaattggcataatggagattatctacctcatggggatagcatgtcttgtctgagcaaagggagagtggatagggattgtaaggatcaaatgggatcatgagtgtaaagtacctgtagaggacctagcacatggtaagtgtataacacttgttgttagagtaacagttttccctgagtatccgtgggagatttgttctagaatccccagaggaaaccagaatctacatttgctcaagtcccttacataaaatggtgtaatatttgcatgtaacctacacacatcctctcatatactttaaataatctctgggttacttataatacctaatataatgtacgtactatgtaaatagttgtattgtttagggaataatgacaaggaataaagtctatacgtattttcagtatagatgcaattatcaattttttttcctctaatatttcaatccatggttgtttgaatcaacagatgcgtaacccagtgatacagggggctgactgtattattcctctgtagcttgagggaggacccagcaggatcagccattcctcatcgaccttcatggactaacaaaggctccatttcagaaggtctttttttgtgagccaaggtctcactgtcacacaggatggagtgcaatgcgcaatcatagctcact

SEQ ID NO: 102 - DNA, 5001 bp, Homo sapiens
tgcagcctcaacctcctgggctgaaaccatcctcccacttcagcctgccaactaagtgagactacatgtgcacaccaccatgtccggttaatttttaaaactgttttgggggatggcatctcactatgttacccagactggtctacaactcctgggtcaaatgaacctcccgccttggtctcccaaagtgctgggattacaggcatgagccaccgtgcctggacagtgtcctttcaagcttctcatgcccttacttcctcctagacatggatgtggctcaagaatatcttttacccaagaggaaactttaactcggtcacagaacgccaggtttgggttgcagacgcttcttgtgggggagggaggtcttttcccctgtattcacagaagaggaggttgccaactggagatggttcatttccaagtttgtctggggtcccccagctatgcaggacccagaaagcagatgtctagacatccaggccaatggtctttcactactctgtgagtctcccgtgaacttcacctggaacctggctgggacacaggtccaaaatacgtaacttcagaacatacccagaattccttctgaccagcctggaaaagttctagaaaatcacacttcagccacgtgtacctaccctgtcaggtgccaaggcaggtacagcacacagacaatcccacatgacccttgcactgccccgggggtgttaaaagagagccttcccggttcacagacttacacactgaggagcagagccagaaattcattcaatcctgctcgcactttgaagatggtcctaacagcaggaacctaaggggtcagggggccccaaagctccagaccctgatgtgtccttactgggcagggcaagaaatgggtttttccccctgaggcaggatcagtggctccagtctgcggcagtcccacatggatcccctactacccctacgcaccggtcctggcccagggctagctccttggtgagaaactcaaagaagtgggcgctgtggctgcggttgtcctcggcggtgcccactacgccgatggaggagatggacagctgcgcgcagggctcggtggacccgctcagcgccatggccaggcccggccgtaccgtcacgttcacgcgctgagggggacatgaaaagttttgcccgaagttggagccggccgggctacctctggggacgggacccgagcgcgcgaaagccgaaacgcgcagtgttcgcggggcagggatcccgatacgggccgcggtccctgaaggtcacgcccgggtcatgactggggagggcgacaagggaaagacgtgcggagggggagccgcgggatcgtggagcacggaaagtcagagcttggcgtgaggaaaggagtggggagtggtccctggggaaaagattcggggtcactgtcggggaggcggagcagggacagggccggacccctggcccaccaacctcccctcgccccgtgctgcccggcccacgcttacgtccgcaggtttgcccaggatggaggcagcggcggcgcagagtcgtttctccagccccgcgggcactcggttggcgggcaaattcgtgtccagctccaggaacggcatggcgggcagaggaacggaaacagctctggcggaagaaaagctgggggtacccaaggctcgcggaccagggaggaggggcgaggcgccacagcaacctggcttctcattggctggacagagactcggcgctccccgattggctgcctagggtacctcccgcttctgcaaacaaaagtcacgtgtgccggctgatttccggaagtcccatcgtctccgccctacgtgtagccccacccactacaggtctttaacccggtagtggacccaccctgtctcccccgaccctcctgcctggcgccaggtgggtttccctctcaagcttccgcgctgtggtcgcccggttcctagccctattagaggtctgaacaccacacccccgacacacaaggacacacacacacctataggggtcttccccaggctcgaccctaataaccaatacaacgggagcttaaagtttttttgaatgatttgccaccatttcgaagtcaggcaatttcatgttcagtatggaaatctgcgcttgggcagtcaggagatgtggttactcgcgggggcgcgggtagggctaggctcacgacaatacctgtccctgcctggtccccattgacatctgcctgtgtagcctcttgtgccggtggtgagccactgtccaccagggggtggcaaaatatgttctttaaaacatggaaaggccgggcacggtagctcacgcctgtaatcccagcactttgcgaggtccaggcgggcggatcacctgaggtcaggagtttgagaccagcctggccaacatgacgaaaccccgtctctactaaagatacaaaaattagccgggcgtggtggcagacgttgtaatcccagctgctcgggaggctgaggcaggagaatcgcttgaaccggggaggtggaggttgcagtgagccgagatcgcgccattgcactccagcctgggtgacagagcgagactccatctcgaaaaaacatcagaaaacatggaactctgttggcgtggcttaaacatgagtgtggtcagtgtggcaaaatcacttgaattgtacattacaaatatgactgaagttgtggtcgagcaatgtggctcacacctgtaatctcagcactttgggaggctaagaagggaggattgcttgagcccaggagttaaagatcaggctaggcaacatagcaagattctcttctttattttctacaaaaaaaaaaaaaaaaaagaaagaaatctgggtgctgtggtgtgtgcctgtagtcctagctacctgggcggctgaggcaggaggattgcttgagcgcaggagatctaggctgcagggagctatgactgtgccactgcactccaccctagatgacagagtgagacccaggctcccccctcccccacaaaaaagaaagaaaaaatttgcaagtttatatgtacaatttcaactacgtgtataaaattctctataagtgtgcatacttaaaggagcctccactgaaaggccgacagagtctctgtctgtcatgatcttgtcctattagcagtttgtttattagatgactcagatatcagaaggtctgagacacacgacaggtaaatatgacagtcctaaggggagagggcagggacaggtggcaagtctgggaccaggtgtggggcatggacaagccagtggtccgggagtggggtgtagagaagactgtggtcaaggttatgaggaggcatgggagagggccaggaaataaccagggacttcccttcctgcaaggaggttcatgaaccagccctgcaccccacttgtggaacacaacatcgccccacagtgaggagagagaccgaggagaccaaggctgatcctgattcagacatctttccaccaggtcacccctcatcgatgatacatgctcagtccgggggtatcccccgcaaggaaacactggggctgaggagcccagagaggtcgcctgacctggactggggctggggaggtcagggaagtctccctggagaagagacagggtgccaaatgccaaaagaccaggaagggcaccaggcgaagatgaggagggaacagcatgagcggaggccaagaggccaaggtgggagcccagagaggggttaggagtgtgcaggcagaaggggccacctggaggagtgggagcaaggccttgaatgcaaagttcaatgacttgtactttagcttctgggcagtgaggaaccatacaaagttccacacagaaggtcagggtcaagtaagcgtttgcccaagctcttttcagaggtcacatggaagctagaatggaatggggtaggagacaaaaggaatgcaggcatgatatctggaggaactgtggaccagagcctttgcagatatgtcttctcttcaaccaaggagacggacagctccatgtctttattctaccaacacagcatcccctcagtggctcagcaagtgtgggacacgcactcacagcaagaaaagctgcattaaggtcttcagattctctttaacagcaggttctactggaggcaggtccttggccttcaggacagctgggagggcctcctggaagaggtcctcccgcactgcagcctccacgtgttgggcaccatgctgccaccgtgggtccgctttcaaagactcagcagccagcactgatgggctaggggaagacagagtcagcggaggggctgggcatagccaagtgtaaggcagcatgacctgctttaggggttctctgattggattttccctcctccaccatgtgtgtgatgggctaggatgtccccctccctggggacacttggaagcctcttaatatagctgcggtgaggggtttgtaaagccccattttatagatgaggacactgaggctcagaaggagaagtgactcacacagggtcccacagccagaaaagacaacatgagctgggatgtcagctcccttcccggatacaccactgcccagcgggccaccgcaccccatggcactctcatgcctcagctccgtgattgccaccaagccagccacagagatacggggcccagtaaggaaggcctggtcccgcaggaacttgtcctcgagcagctgcaggcatccgtccagctcagccaaagtggccgccaacatctcgggtggcactgactcgcccaggaacacagggattattatctggtgggccgacaggcagagagaggggtcagggtctgcccaaagcccatcctggttcccaccatcatcctatcatcaccagtccttgggatttctgctcacctctgctcacttctttccactcatagccaccagtagctctcatctcctactcaaacagggacagcctcccccttctccctgggtcctcacacaaggcaaccagtgggatccttctgtaatctcaatctgc

SEQ ID NO: 103 - DNA, 5001 bp, Homo sapiens
cccgtaccctctcttgcataaagccttccatggctccccactgccctcatgagaaaggcctcaacacaaagccagccttctccagtgcggtagccatcccctccccacttttcacctcacctcctactaccccccacttatcaaacgggaatgtgtgtatgaatcctccctggaatctggttacagtttatgctcccaatcagtaaggtcagagtggggcctgagcctctgcatttccaacaagctccctggtgatgctgatactcccagtccattgaccacactttggataggaagagtctacacttgctctactcaacttctctccattctgtcctcaaacacaccacgcttccttccccaccagctggagggggctctgctcccaggccccagaggtcaaggcagacacagttaaggtgtggaaacctccttattgcccgatggatcctccagagaggcggtcccttactttcagcagggcgcgtgtctacctgtttcatgctgtctcacacacagggtgccacccctgtgctgggcactgggtaagtgctctgtacatattaattaggagtactcatttcaaaaatatgtgtgcctttgataaataaaaacagtatgtgcatgttgtgttggtgtgtgcttccttgattattactgaagttaaacatgttttcatccatgtattgaccatttctctttgtccttcaatgaaacctctgctgatttccttcgctcatttttttcctgtgtcttcgtctgatgagtttctcttctttttgtttgttcgtttgtttgttttgagacagtctcgctcagtggcccggctggagtgcagtggtatgatctcagctcactgaaacctctgcctccaaggttcaagtgattctcctgtctcagcctcccgagtgtgccaccgcacccagctaatttttgtatttttagtagagacggggcttcaccgtgttgcccaggctggtctcaaactcctgacctcaactgatccgcccatctctgcctcccaaagtacagggattacaggcgtgaaccaccacaccccacctgtctgatgggtttctaagaacatcttaaaggacattacttccttctgacgtatcttttaccgagatccttcccagttttttgcttaaggttaatccattttttcctccacaaagtaaccttgtatatgtattggttttttctttgttgagttctcccactgttctgaggcttagaaagtcctttcatacccagacatcagagaaacagatcccgtgagagtaactgggattgcaggtgtgggccagcatgccctgttatcactccctttctctgagtcagcttttctctctcagtctcgtctactcctcgaactcaggaaatgtcactacaggtggccccagctcccgtttacctccccatagggagctcctctctccagttccagtttcaaaactcccaaggaagcattctggttcactcgcttgggccactggccagagggatgggatactctgaaagattcagctagagtcccgggcccagccctggaccatcactgtgccccctggtgagatgccagggctgggattcagggagaagaaaggaggttcccggacagtcattcctgcctcccgcggctgcgggctccctgcccccatcctgtgcacgaagtgggagctcccgctgtctggcagctcccgctgtctggcagcagctgctctgcaggggacagtctggacggcagaaagttcatccttaaccccagccttccagtcaaggttcccaccagtttgggacacctgcaagtgtcacatcccactgggtgaaactctaagatcccttttaggggatcccattcgctccctcccttccgccaccatgcagcgccgagaaacagagctctgaacgaaccctcagatgtccgtgcgctggggcctttccaggacggcggcgcccagtcgtttctgggtcagggcgacgcctggaactgggcagggtccctggcaccgggatcccgaaaagcagacctgcttctccctgtccagccggttccccttccccttgcagtcggccccctgcatccgcgtcctccctgccagtcgagggtccccagctccaactccaccctcccagctgtgcgttcatagcgaccgccctccctgtagggacgcacggatctggtggtggagtcttggccggcaggactggacaggaaccgaaggggcgaggcgggtccgggggtggtgcgctccaattgggtgctgtccccagggggtggggcctgatcccctatttcccggcgcgccgggatcctgccacagctgctgcccacaccgcgctcagcgccttcactgccatccccgctgtccttgccgcccccgccatgggcctagagctgtttcttgacctggtgtcccagcccagccgcgccgtctacatcttcgccaagaagaatggcatccccttagagctgcgcaccgtggatttggtcaaaggtgggcccagcccgtttccccgcgtgtccacaaacccagtgcacccccaggcccccgccctgctctgccctgagcgtctcgccgcccgcacagccccctcacctcctcctgcagcgtctgccaccagagaatgctgtggactgagtggccttgaagggatcacagcctctctgaaccttagcttgccttctgaaaaggaggataacgttaccttctgctctgtagggatggaaagaaaatactgaatggagttgacagagttcttgcgtggaatgcacgcatataaattcacaaagcccagaagacctcgggaagaaggacatactgttgtgagaattaagagatgggaagagatgagccaccccagtttgcctcccctcccctggcccaccagagtccggctagaaaacttctctttatccacctgctgcacctggccccacccaccaaaaccccccagctgccccggaatgtggcagggcagggaggcccagccagggagtgaggctgatccaggcctctagtcccagaccttgctgtttctcagggctgtggggctccgcttggggaggaggagggagggtgtagaggtgcagcgtttttactctgaagaccttttctgacttcttcctcttcagggcagcacaagagcaaggagttcttgcagatcaacagcctggggaaactgccgacgctcaaggatggtgatttcatcttgaccgaaaggtgccctccttccctcacccctcaccgcatccggagcccatgtgaccttggctctccccactggccccgggccccagtggccctcccataccccatggggcagcgagggaggggaaaggcgagggatctggccgggcgcggtggctcacgcctgtcatcccggcacttcgggaggccaaggcgggcggatcacgaggtcaggagaccgagaccatcctggctaacaccgtgaaacaccgtctctactaaaaatggaaaaaaaagttaaccgggcgtggtggcgggcgcctgtagtcccagctactctggaggctgaggcaggagaatggtgtgaacccaggaggcggagcttgcagtgtgctgagatcgcgccactgcactccagcctgggcgacagagctagactccgtctcaaaaaggccgggcgcggtggctcacgcctgtaatcccagcactttgggaggccgaggtgggcggatcacgaggtcaggagatcgagaccatcctggctaacacggtgaaaccctgtctctactaaaaatacaaaacattagcagggcgtggtggcggccgcctgtagtcccagctactggggaggctgaggcaggagaatggcgtgaactcaggaggcggagcttgcaatgagcagaggtcgcgccactgcactccagcctgggtgacagagggagcccactccagcctgggcgacagagggagactccgtctcaaaaaaaaaggaaagaaagaaaggagaggtatctggggagaaggtacagcttggggtgtgtccgggatgagcaggggctgacagaacatgtccccccacctctcatcttcagccttttctgagccgcagggcctctccactcccagactgaagggtattagaagagaagacaagggaacatttttccactgttgcgcatttgttcaacaaatgctagctgaaaagagcctctagtgacttgtcgcagactacccaatctacccaggccgggcctagaggccaatgccatggcccaagggcacagctcatggtgaggtccagctgctgggcaggaaaaggacaagaggtcaggtggctgcagaggtgatggctgggggcctgtcagacgggggccaaagacattcctcccctcgtgatccctgacccaagcgcgtggacatgcaagggactccacggagcatccactgtgtgccagccccatgcagggttccaggggtccagggagcctattctgagctgcaccgcctcggacaagtcacttgaccattctgaccttgagttttctcttgtgctaaaaggctaacaggagtgtctacctcacagggcggctgctggcatatcacagagatgaggttctcaaaatgcaaagcagaaggtccagccaagagtcggtgcccaaggcaacaaagacaggaggagactcgtaggaggagggggtggtgttggggagctggagatggagggcgaggctggagggcagtccttcaaatgcagagaagcccccgggccccactggcagatgggagcagttaggggtaaatgcctggtgccagtgtccttatagccactgcccatttgttcccagctcggccatcctgatttacctgagctgtaagtaccagacgccggaccactggtatccatctgacctgcaggctcgtgcccgtgttcatgagtacctgggctggcatgccgactgcatccgtggcacctttggtatacccctgtgggtccaggtgaggagagccatctggagagtgattggcc

SEQ ID NO: 104 - DNA, 5001 bp, Homo sapiens
catcagggagtagttggcagtaggccggggccatagactgacccactctctgcccccatcaggtgttggggccactcattggggtccaggtgcccaaggagaaggtggaacgcaacaggactgccatggaccaggccctgcaatggctggaggacaagttcctgggggacaggcccttcctcgctggccagcaggtgacactggctgatctcatggccctggaggagctgatgcaggtgtgagctcagcctgtgggcagtgtccctcttcgtgtcacacccatgaggcagacagaaacactgaggactggagaaagccagaactttgcccagaatcatagagcaagtctctggatgatctggggccagaaccctgaacttctgcctcctgcctgggtgtggggtctcaccctggctgctcttgggctctaaggctgaacatactgcctgggcccctgtggtccattcacttaggggctggggaatggaccatgtctctgatacttctgcccatggttccagcattcgggtcggcagtgacaactgggaaagttgtatgcccacaactttttcatccttgtccctacagccggtggctctcggctatgaactgtttgagggacggccacgactggcagcatggcgtggacgagtggaggctttcctgggtgctgagctatgccaggaggcccacagcatcatcttgagcatcctggaacaggcggccaagaaaaccctcccaacaccctcaccagaggcctatcaggctatgctgcttcgaatcgccaggatcccctgaagggtctgggatgggggccaggagattagcaacaaggattcattctgttacttacttgcccctttttatctttccctcttgccccagtcccttctctccagcttcatgtgaagctctgcacagacaagacactcagtgtccttggcagtgctgctactcctcaggtgcagcatacataaccagtaagagactaaatctgcaatatataaagagctcctacaaatcagtaacatgaagaacactcaaaaattggcaaatgtcatcagtgttttaaacagaataaagattccaaacactttgaatagagaaccaagagttattggttttactacattgttgtgttatacatatggagtaaaagtatgtgctagtaatcctcatcatggttaataacaaagtaacctcacaataacgagtcaacataattgtatcaccagggcaacaaaatgttaagtaagtaaccaattcgaattgcaaactgttaaaggatataggcgatgtttcacagggcatagcaacggtctttgaagtctaggaaacttaaaagatttcttttaacaagcattcatgtcttctaggacagttttgtaataactgcaaatagtaagattatacattgtcacacagacctccatgtatatccatgggatggaccccaccacaatgattttaacggagagaacttgatataaagaattggtaaccaggcattagagaactccgaagacagagagaatccagattaacacggaggtaaacactgcaagaagctaccacccctagggctgggggatcaagggaggaattaggaagaccaagatgctggaggggccctgaagaattcaaacctccaagaaaggtgttgctcatcccccctagcatcaccttccaagaagggcaggtttccccagtttgccctgaggtcttcacaggaggccatgtggctgtggatgcagttctcaaatgtgacagtagatgtcactgctgaccaataaacaggatgttccagacacactctgcgctacctgcccacatgtcttgtggctttggggcctatttcccatgcctgacctgtgcccaccatgtgccactctattgggggacctgccccaataatcacgtagattgtttcctatttttcctaagtgtcggccggcttgagaaataaagggacagagtacaaaagagagaaattgtaaagctgtgcatccgggggagacgtcacacgttagtaggatctgtgatgccccacaagccacaaaaaccagcaagtttttattagggattttcaaaaggggagggagtgtgcaaataggtgtgagtgacagacatcaagtacttaacagggtaatagaatatcacaaggcaagtggaggcagggcgagatcacaggatcacaggaccgaggcaaaattaaaattgctaatgaagtttcgggcaccattgtcattgataacatcttatcaggagacagggttttgagaccaaccggtctcaccaaaatttattaggcgggaatttcctcttcctaataagcctgggagcactatgggagactggagtctatctcacctctgcagtctcgaccataagagagaggccacgcccggggggctgtttataagccgatacctccaggtgcgtattctctttctcagggacattccatgctgagaaaaagaattcagcgatatttctcccatttgcttttgaaagaagagaaatatggctgtgttctgcccggctcaccggtggtcagagtttaaggttatctctcttattccctgaacaattgctgttatcctcttcttttttcaaggtgctcagatttcatattgctcaaacacacatcctgtacaatttgtgcagttaatgcaattattaaagggtcctgaggcgacatacatcttcctcagctgacaggattaagagattaaagacaggtataggaaatcataagggtgttgattggggaagtgataagtgtccatgaaatctttacaatttatgtttagagattgcagtaaagacaggcataagaaactataatagtattaatttggggaactaataaatgtccataaaatcttcacactccacgttcttctgtcatggcttcagccggtccctctgtttggggtcactgacttcctgtaacaccactcctagccggaagtattccaagtaaccattgcaactgtcctgccttaagggtgcctggtgatggcttctgtcttaggtcccattctggctctctcttccagtgatttctcatactttgggggacactctggcctgctttcctgggccttttccattaccaccccctctccccatcaggcactggggatggcggccacagcctatgccttcttgatccatgctggctgccttgggattgttccttattggatggttttgctttcaacagacactccaataaagtacacgaaataaagaataaagttaaacagtcagtccccgtgctgtgtaggtggcagtaagtctgggagagcgacctcagctgaactaaccatgctgtgcatcattgtcaagcgggaccagcaggatccttaggtcacctggcaggaggaggggcagggaagggtccctagaagtgatcttgagttgcacttagtgctcttggcagagggaagggcttgggctagtgctggaggcatgaagatggggtgtgttcagggctctccagcagtccaggcatgggaaggggacgctgagggccaaaggctaaggtgacactgggaagggaaccatagcaaggtgaggaatggctttcggccatgtgactgaattgcctgtgtgtggtgcgtgtgtacgtgtgtgaatgtcagtgaactgtgtgtgtgaacgtgagtgaattgtgtaactttgtttatgtgtgggtgtatatgtgtgtgatgtgagtgaactgtgtgtatgtgggtgtatatgtgtgtgatgtgagtgaactgtgtgtatgtgggtgtatatgtgtgtggtgtgagtgaactgtgtgtaagtaggtgtatatgtgtgtgaatttgaatggtgtgtaaatgtgactgagcagtgtgaatttgtgtatgtgggtgtatgtgtgtgagtgaactgtgtgattttgttggtgtgaattgtgtgcctgtgtgtgtgaggtgtgtgtgtgtgtgtgactgaactgtgtgatgactttgtattaatgtcagtgaatggtgtggttgtgtatgtgggtgtatatgtgtgtgtatgtatgtgaattgtgtgtggggttggtgtgtatgtgtgtcaatgtgagtgagttgtgtgactgttgaatatgagtgaattatgtgattgtgtgggtgtatatgtgtgtacaggagttaactgtgtgactgtgtgtaaatgttatgattgtgtgtgtgggtgtatatgtgtgaatgtgatacatcgtgtgactgtgggtggacgtgggtggatgtgtgtgtgagtgtgcgtggctgtgtgtcgaacagtgtgtgagtgtaagtgtgcaggtggtagctgtggaattaaggcacattaggggaatccttccttggctctggtccttggtttccctcctatgaaacaagttgggtgaattaggcagtctctggcattccaggatttggtctcaggtctaaacaggattttgtaaagtgaaagcagcatcccttgggcatcccgggaggtgtccctgccctccatggctcaccttctgccacatggcccagcagcagctactctgcagggccatgtgctgccatgacaggtactgatccccatgggcgcgggcctgcaggtcctggaggtaccagtggtcaggtgctttgtacatgcagctcatatagagcaagctagccacactggggggacatggcaggggcagaagacatgccctgaacactcttcagccattttctggggcattttcactatccccatgatgcagaggagggatgtgaggctcagagaggttaggtaactgcccagggtcacacagccctacacggggccagattatcatctcaactaatggcagcaaggaagaaacaaaatgtcatgaacttcagcaggggctcagggaaggcttccaggaggaaggggcacccagtgtgagtctgaagaatgagagcaagttgggtatctccccaacatatccaaagcatggacagggccaggagcaaggccagcagggagagagcc

SEQ ID NO: 105 - DNA, 5001 bp, Homo sapiens
cttccaggtgacatggcagcattgctccccaccccgtcccatctcctgttcacctatggtgaagggttgtgcagtctgacccccagagctcatcatgcctctatgggtgttggaccatccagtgatcccaggctctgaatgtgaatccagctccaccaaggaggcactatgtggcctcggtaaaggacgccaccatgcggccaccaacctggaggctggttttggctttcatttttcccacccacctccaacccttcagcacaccctgcagttagagtttcaagaaaagtcagaaccgaccatcaccccaccaaccctgcaccaccaccaccttggtctggggctccagcgctgcatgccagatgactgcagtggctttctcacccctgccagggggatcctttatgacgtaagtcagatcacagttctcctctgctcaaaatactccagcgactcaatccccctgcggtaagagccaaagccttcccagtgtcccatgctcccctctgtcgtgacctcctgctcttcctgctcactacacccaccctggcccgttgctctccagtctgaaccccatgcattgtcccacctggagccttcgccctcactcttccctccagccagaacacccttctcctcatgccttgcacattcctacagctctctgctcagatgccacttcctccagggagtcttccctcaacatcctactcacacacccccaatcttaccctgtttattttttccatggcatccatcaacatccgatatgttccatgtttacatgggttactgtcagctcccccttctattaatggaatgtgagatccatgaggagaaggacgtagacacgttcactgctcaagccccagggcttaaatggggtctggccctggtggatgtttagcaaatagccactgaagctcgctgagtggtccctcgactctccagggaaacagcacttgccccacaggatttgtgggcaaaatggtagcactaagatgcctggtacagccgctcctcgaaacttagcactctccttttttcggaggggaaggctggcggtgaggaggcccggaagcagactgggccctgtggccttgtgcaagtccctcccctcctccagcctcagtttcctcacttgtacaatgcaggaggggacttctataacccttgtcaacactgggcaccactgcctgcctccacccattcttcaccctggggctggtgcagggcccacagtccatgatccaagccatcaacagtgaacagacagccgactggccccacaaggcccggcagcagcccacggaccggttacctctcagccaaggtgaagtccccatccttcaaggcccggcaccttcctcagggggttcacctgggcaaaggcatcgctgtgctgctggcctgcaggagagatcagagaggtgagtggggataacccagagttctctgaggtctctgcccacccccaccccaaaatcccagcagcagctttctgaggcccctatctgggaggcatcagggaagaggaagcctctctgctagtcactgggtcacagaccttgaccccatcagagggccatctttcctgtgtccagctccttgaagcatggctcaaggacaattccctggagctgtaattcacaccccacccccagccagttccatccataggtcagacccctccagcctcctccctgggctctaggcttgccccctctgattcagcttcctatcccagctggggacttaggccctactggccaggctgggtgacctgtcaataccccagagtcccagccaaacatgttcccaaccctcagaccaacctcattcttgctgggaatccctgccccattcagccactcagcccccggtggctcagctcttcttcctttcttatgccaaactctcaaggctccctccccactgggggttcccaggtctgactcactttagcattctaggccagtgctagaggccgcattaggtgcctggtgtttggatcagaggacctcagtcaagccaggctccagtctgatcataggcctacatgtgggcctctttgcccttctactgaatggacatgcacacccctgcccattctccctccacagactgcttctgtgtccagcccctgttctgtagcaggtgactcaagctggttgtaccaagggcagcagttgggaagagtcagctgagcagggtcctccctctggcctgcccagggggctctggctctgctctctgccctactgcttagttatagccctgcctcctccactgaattgtgctccagctgcatctctgtatgccagccagaccagcaaacgctggagctcagggtgagggtgctggcctcccccactgccctgccacagggccctccagcctctagcctctaggagtagccccttcagctgggtgagaagccccatgggatagagcaagtcagatgcaggaaaaagaaaagacagaagaatgccaagaaatacataaaagtggaagagacccagggccagacatggtggtgcatgtctgtgatctcaacactttagaaggaggaggcaggaggatcacttgagctcaggagctcaaggtcagcctggtctacatggcaaaatcacgcgtctacacacaccaaaaaaaaaaaaaaaaaaagtagctgggcacggggacgtgcctgtagtcccaactattctacttaggaggagtaagttgggaggatcacttgatcctgagaggtcaaggctgcagtgagccgggatcatgccactgccctctagcctgggctgcagattgagacactgtaataaataaataaataaataaataaataaataaataaacaaacaataaaaaagtggaagagacacaggcaggggtagacagggactattttacttaggaaacaacgaggcagtttgttttttccaagcacatggggtgaagatattcttgccccactccatttccctaccctcgttctgtgcctgctgtgccctctctaaacctgtattttgaagaatgttttgtattcacaagcaaagatcaagcctctattaaaatagacaaccagtggggcatggcggctcatgcctgtaatcccaacactttgggaggccaaggcaagaggatcacttgagcccaggagttctaggccagcctcggaaacacagcaagacctcctctcaataataataataataataataaattggccaggcatgtcggtgggcacctgtagtcccagctacttgaggggctgaggcgggaggatcgcttaagcctggaaggtcgaggctgcagtgagccatgattgtgccactgcactccagcctgagtgacagagttagatgctgtctccaaaaagtaaaaataataacatagataattatgtaatagtttccacaccggagagtctgattcttcgtgttagtctgcattcttggcccgactgcaaagcagcggggacaggcagggattcgtggccaatatcccctgggcctgcctgcccagcccagctttggtcagctccactgtgcgaagctcgaaggggatgccattcttggcgaagatgtagactgaacggcagggctgggacagcagacccatggcgggggcaatggggtggggcgtcggagggcagacctaaacccaggggacgggccctggggacaaacccggggacaggcccgggaacaggaactgcgggcaggaatggctggttgggggcggcggacaggaacggctgggggtaggtgagggatgggcaggaactgctgggtcaccgagcctgcagcggtgcacctcaccaggagccccgagtccggccacgccctcttcactcatcccttggctcctagaactttgggtcaatcagtggcgtgtctgctctctcaccacccctttctgggaatctaggctgcaggtatatttcccactaaaagggaagaggagaggctgggcgcggtggctcacgcctgtaatcccagcactttgggagaccgaggggggtggatcacgaggtcaggagatcgagaccatactggctaaaacggtgaaacccgtctctactaaaaatacaaaaaattagccgggcggggtggcgggcgcctgtagtcccagctacttgggaggctggggcaggagaatggcgtgaacccgggaggcggagcttgcagtgagccgagctcacgccactgcactccagcctgggcgacagagccatactccgtctcaaaaaaaaaaaaaaaaaaaaggaagaggagaaaggaggtgcagcagcctccttgcccagtgcctgggcccagtgcccaggacggaggccagagaggaagggtggctgactgcctgcggggctgccagccccacacctcatgaaggaatgagctgtccctccccagttgctggggtcatatttgttacactctagctaacgcctccccgagatggctgaggccctgtgaggcctatccagaggtttccaacagtgcctggcattgcacagtaaattaatcaccatgacacgagttttgcaaaagagaaaagatttattcacagggcaccaagcaaggatgtgggatagtagctctcaaatccaccttcccgaaaataaggcttagggataagccttgcttccaagcagtagagcacaggccccagccacgctccagggtaggggaccatacaaggatgtgaatagcagtgtcggccttgtgggcctacaacgcagaagggccatgcacttggtttaaagctttgctgttgccatcttaacattcttaacaagttaaaaataagggtccccacattttcatttatagccagtcctgtccaaggagttcaaagatctcatgagggtggacagggcactgtctgctctgggcagtgatgggaccactaacagttgttctccagtctcccagcgcctaccccagggacacaccttcccctggtctctactattctttttttttttcgagacagggtctt

What is claimed is:

1. A method for treating Parkinson's disease in a human patient, comprising the steps of:
    obtaining a sample from said human patient, said sample being serum or plasma; and
    identifying differential levels of SEQ ID NOS: 10, 12, 13, 14, 23, 24, 27, 33, 34, 35, 55, 58, 62, 86, 89 and 93 within said sample compared to those of a healthy control;
    diagnosing the human patient as having Parkinson's disease based on the detection of differential levels of at least 2.066, 2.066, 2.568, 2.568, 3.927, 2.275, 0.663, 0.663, 0.663, 0.663, 1.327, 1.327, 1.327, 2.306, 1.842 and 2.471 fold, respectively, in the sample above that of the healthy control for each of SEQ ID NOS: 10, 12, 13, 14, 23, 24, 27, 33, 34, 35, 55, 58, 62, 86, 89 and 93; and
    administering L-dopa therapy to the human patient diagnosed as having Parkinson's disease.

2. The method according to claim 1, wherein the differential level of said DNA sequences is determined using direct quantitative real time PCR in said sample.

3. The method according to claim 1, wherein the differential level of said DNA sequences is determined using quantitative real time PCR.

4. The method according to claim 1, wherein the differential level of said DNA sequences is determined using labeled antisense nucleotide sequences.

5. The method according to claim 1, wherein the differential level of said DNA sequences is determined using microarray profiling.

6. The method according to claim 1, wherein the differential level of said DNA sequences is determined using high throughput NGS sequencing.

* * * * *